US008481701B2

(12) United States Patent
Jarrige-Le Prado et al.

(10) Patent No.: US 8,481,701 B2
(45) Date of Patent: Jul. 9, 2013

(54) PROCESS AND METHOD FOR DIAGNOSING ALZHEIMER'S DISEASE

(75) Inventors: Anne-Charlotte Jarrige-Le Prado, Paris (FR); Pascale Beurdeley, Fontenay Sous Bois (FR); Diego Pallares, Paris (FR); Fabien Rouet, Rueil Malmaison (FR); Laurent Bracco, La Garenne Colombes (FR)

(73) Assignee: Exonhit Therapeutics SA, Paris (FR)

( * ) Notice: Subject to any disclaimer, the term of this patent is extended or adjusted under 35 U.S.C. 154(b) by 10 days.

(21) Appl. No.: 12/935,098

(22) PCT Filed: Mar. 30, 2009

(86) PCT No.: PCT/FR2009/050530
§ 371 (c)(1),
(2), (4) Date: Dec. 20, 2010

(87) PCT Pub. No.: WO2009/144424
PCT Pub. Date: Dec. 3, 2009

(65) Prior Publication Data
US 2011/0086776 A1    Apr. 14, 2011

Related U.S. Application Data

(60) Provisional application No. 61/044,097, filed on Apr. 11, 2008.

(30) Foreign Application Priority Data

Mar. 28, 2008   (FR) ..................................... 08 52042

(51) Int. Cl.
*C07H 21/02*  (2006.01)
*C07H 21/04*  (2006.01)
*C12Q 1/68*  (2006.01)

(52) U.S. Cl.
USPC ........ 536/23.1; 536/24.3; 435/287.1; 435/6.1

(58) Field of Classification Search
None
See application file for complete search history.

(56) References Cited

U.S. PATENT DOCUMENTS

2001/0053519 A1* 12/2001 Fodor et al. ....................... 435/6
2007/0082350 A1   4/2007 Landfield et al.

FOREIGN PATENT DOCUMENTS

| FR | 2900936 | 11/2007 |
|---|---|---|
| WO | WO 03/028543 | 4/2003 |
| WO | WO 03/054143 | 7/2003 |
| WO | WO 2004/079014 | 9/2004 |
| WO | WO 2004/112589 | 12/2004 |
| WO | WO 2005/020784 | 3/2005 |
| WO | WO 2005/076939 | 8/2005 |
| WO | WO 2006/002262 | 1/2006 |
| WO | WO 2006/020269 | 2/2006 |
| WO | WO 2006/125830 | 11/2006 |
| WO | WO 2006/138275 | 12/2006 |
| WO | WO 2009/074331 | 6/2009 |

OTHER PUBLICATIONS

Gardina P.J. et al. BMC Genomics (Dec. 2006), pp. 1-18.*
Hoffmann E.P. et al. As The Tumor Analysis Best Practices Working Group, Nature Reviews—Genetics, Mar. 2004, vol. 5, pp. 229-237.*
GenBank Locus: AB000461 'Homo sapiens mRNA, complete cds, clone:RES4-22C.' Apr. 14, 2000, from www.ncbi.nlm.nih.gov, pp. 1-4.*
GenBank Locus: CQ834138 'Sequence 9 from Patent WO2004058805' Jul. 29, 2004, from www.ncbi.nlm.nih.gov, pp. 1-2.*
GenBank Locus: AX780939 'Sequence 3096 from Patent WO03039443' Jul. 14, 2003, from www.ncbi.nlm.nih.gov, pp. 1-2.*
GenBank Locus: AK023239 'Homo sapiens cDNA FLJ13177 fis, clone NT2RP3003870, highly smilar to binding protein (VprBP), mRNA' Sep. 16, 2006, from www.ncbi.nlm.nih.gov, pp. 1-3.*
GenBank Locus: AK074705 'Homo sapiens cDNA FLJ90224 fis, clone NT2RM1000789, highlysimilar to transcription factor 7-like 2, T-cell specific, HMG-box (Tcf712), mRNA for hTCF-4' Sep. 13, 2006, from www.ncbi.nlm.nih.gov, pp. 1-2.*
GenBank Locus: NM_004844 'Homo sapiens SH3-domain binding protein 5 (BTK-associated) (SH3BP5), transcript variant 1, mRNA.' Jun. 15, 2006, from www.ncbi.nlm.nih.gov, pp. 1-5.*
Beurdeley P, et al "P1-343: Discovery of blood gene expression biomarkers in Alzheimer's disease using the human genome-wide splice array" *Alzheimer's & Dementia: The Journal of the Alzheimer's Associate.* vol. 4, No. 4 (Jul. 1, 2008) p. T319.
Maes et al. "Transcriptional profiling of Alzheimer blood mononuclear cells by microarray" *Neurobiology of Aging.* vol. 28, No. 12. (Oct. 12, 2007) pp. 1795-1809.
Ray Sandip et al. "Classification and prediction of clinical Alzheimer's diagnosis based on plasma signaling proteins" *Nature Medicine.* vol. 13, No. 11 (Nov. 2007) pp. 1359-1362 (Abstract only).
Wilmot, et al "Translational gene mapping of cognitive decline" *Neurobiology of Aging.* vol. 29, No. 4. (Mar. 3, 2008) pp. 524-541.
Maddalena, et al. "Cerebrospinal Fluid Profile of Amyloid β Peptides in Patients with Alzheimer's Disease Determined by Protein Biochip Technology" *Neuro-degenerative Diseases.* (2004) pp. 231-235 DOI: 10.1159/000080991.
Wang, et al. "Preliminary studies on Alzheimer's disease using cDNA microarrays" *Mechanisms of Ageing and Development.* vol. 124. (2003) pp. 115-124.
Ho, et al. "Altered expression of a-type by not b-type synapsin isoform in the brain of patients at high risk for Alzheimer's disease assessed by DNI microarray technique" *Neuroscience Letters.* vol. 298. (2001) pp. 191-194.

\* cited by examiner

*Primary Examiner* — Stephen Kapushoc
(74) *Attorney, Agent, or Firm* — Occhiuti Rohlicek & Tsao LLP

(57) ABSTRACT

The present invention concerns methods and compositions usable for diagnosing Alzheimer's disease in mammals, in particular humans. It particularly describes serum markers for Alzheimer's disease and their use in diagnostic methods. It also concerns tools and/or kits usable for implementing these methods (reagents, probes, primers, antibodies, chips, cells, etc.), their preparation and their use. The invention is usable to detect the presence or progression of Alzheimer's disease in mammals, including in the early phase, as well as for predicting the efficacy of an Alzheimer's disease treatment.

4 Claims, 6 Drawing Sheets

5A

5B

6A

6B

6C

PROCESS AND METHOD FOR DIAGNOSING ALZHEIMER'S DISEASE

CROSS-REFERENCE TO RELATED APPLICATIONS

Figure 1:
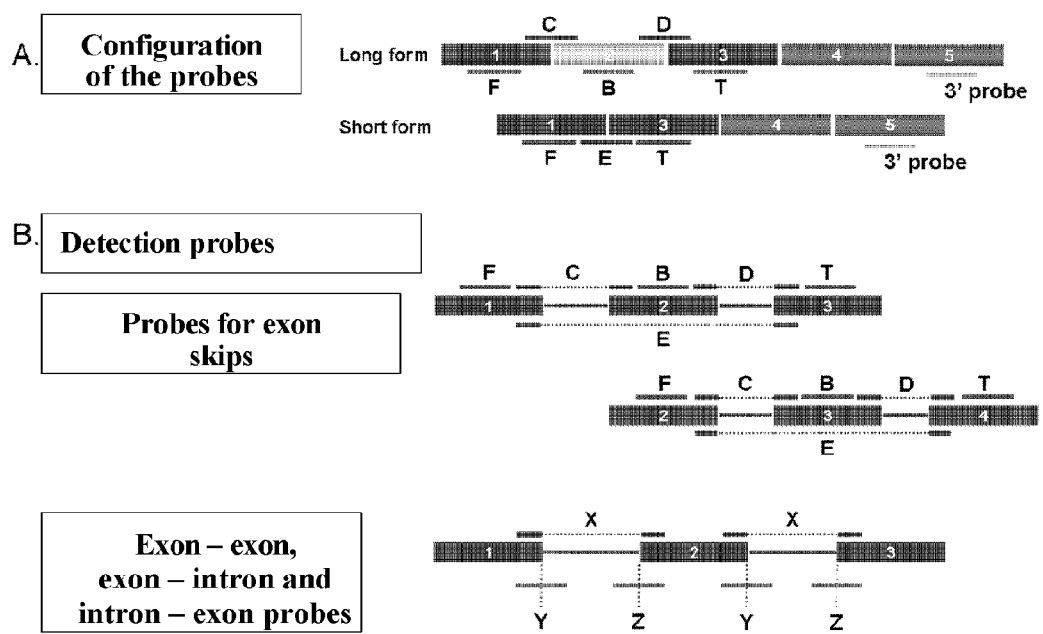

This application is the National Stage of International Application No. PCT/FR2009/050530, filed on Mar. 30, 2009, which claims the priority of French Application No. 0852042, filed on Mar. 28, 2008, and U.S. Provisional Application No. 61/044,097, filed on Apr. 11, 2008, the contents of the foregoing applications is incorporated herein by reference in their entirety.

Two identical copies of a compact disc have been submitted in this application. Both copies contain the following files: 55602-004US1 Table 1.txt (created May 22, 2012; 509,952 bytes), 55602-004US1 Table 2.txt (created May 22, 2012; 251,904 bytes), and 55602-004US1 Sequence Listing.txt (created May 4, 2012; 9,277,440 bytes). Files 55602-004US1 Table 1.txt and 55602-004US1 Table 2.txt correspond to Tables 1 and 2 mentioned below, respectively. File 55602-004US1 Sequence Listing.txt contains a sequence listing. The entire contents of these files are hereby incorporated by reference in their entirety.

The present invention relates to methods and compositions suitable for detecting Alzheimer's disease in mammals, humans in particular. It particularly describes serum markers for Alzheimer's disease and their use in diagnostic methods. It also concerns tools and/or kits suitable for implementing these methods (reagents, probes, primers, antibodies, chips, cells, etc.), their preparation and their use. The invention can be used to detect the presence or progression of Alzheimer's disease in mammals, including in the early phase.

Alzheimer's disease is the primary cause of dementia and the most common neurodegenerative disease. This progressive disease is characterized by memory loss and by deterioration in language skills, orientation and judgment. The nature of the symptoms, often confused with aging-related physiological problems, their severity and their age of onset vary among individuals. This makes it difficult to establish a diagnosis in the early stages of the disease.

Examination of the brains of patients suffering from this disease shows a loss of neurons in the hippocampus, an important memory center, and in the cerebral cortex, involved in reasoning, language and memory. Cholinergic neurons are particularly affected by this depletion.

Another major anomaly observed in the brains of patients suffering from Alzheimer's disease is the accumulation of intracellular and extracellular protein aggregates. Intracellular neurofibrillary tau protein aggregates appear to be well correlated with the severity of the dementia. Senile plaques formed by intra- and extracellular aggregation of amyloid beta peptide characterize regions of neuron and glial cell alterations.

However, it is noteworthy that these areas of aggregation do not correspond to the sites of synapse depletion characteristic of the decline in cognitive function.

Genetic studies conducted on familial forms have shown that 4 genes are associated with the development of the disease: APP (Amyloid Precursor Protein; precursor of amyloid beta peptide), presenilins 1 and 2 (PS1 and PS2) and apolipoprotein E (ApoE). Although mutations or polymorphisms in each of these genes lead to an increased production of amyloid beta protein, the mechanisms that govern the synaptic and neuronal losses remain poorly understood. In this regard, several hypotheses and mechanisms appear to coexist, involving different phenomena:

1. Purely cerebral phenomena involving neurons and glial cells:
    oxidative stress, which can especially be induced by amyloid beta peptide and modulated by cholesterol metabolism;
    changes in calcium flux and excitotoxicity.
2. Inflammation and immune reactions;
3. A change in sex hormones;
4. Hypothyroidism and defects in the regulation of insulin signals.

Consequently, Alzheimer's disease will be characterized by a change in various integration systems regulating homeostasis, and damage to certain neurons leading to both an inflammatory reaction involving the immune system and changes in endocrine regulation. These, in return, have an impact on the activity and viability of other neurons and on immune functions; these cascade reactions emphasize the role not only of neurodegeneration but also hormonal regulation and the immune response in the progression of Alzheimer's disease.

Currently there is no robust and specific signature for Alzheimer's disease, especially from a blood sample, that allows diagnosing this disease, in particular the different stages of disease progression. The availability of an effective diagnostic test, particularly for early diagnosis, would allow patients to be treated from the beginning of the disease and thus to benefit from a treatment that is more effective and more appropriate, in particular by acetylcholinesterase inhibitors such as galantamine, donepezil and rivastigmine, under optimal conditions.

The present invention responds to this need. The invention particularly describes the identification of serum markers for Alzheimer's disease, allowing the development of effective and predictive diagnostics for the presence, degree of severity/advancement or risk of developing this disease. The invention describes the identification of molecular signatures specifically or preferentially expressed in the blood of patients with Alzheimer's disease, resulting particularly from the complex expression of certain genes linked to alternative splicing. The invention particularly describes the identification of sequences 1-5578, which are present in the RNA of blood cells in human subjects, and which are characteristic, alone or in combination, of Alzheimer's disease. The invention therefore offers, for the first time, tools and methods for diagnosing, predicting and/or monitoring the progression of Alzheimer's disease, based on measuring the expression of one or more genes in the subjects' blood. The presence of deregulation in the expression of such genes allows establishing the risk of or predisposition to Alzheimer's disease, or confirming the presence of this disease in a subject.

One object of the invention thus relates to a method for detecting (in vitro or ex vivo) the presence or risk of developing Alzheimer's disease in a mammal, comprising determining the presence, in a biological sample from said mammal, preferably in a blood (derivative) sample, of an alteration in one or more genes or RNAs comprising a sequence chosen from among SEQ ID Nos.: 1 to 5578, the presence of such an alteration being indicative of the presence or risk of developing Alzheimer's disease in said mammal.

Another object of the invention is a method for detecting (in vitro or ex vivo) the capacity for developing Alzheimer's disease in a mammal with mild cognitive impairment or at asymptomatic stages of Alzheimer's disease, especially of the hippocampal or amnesic type, comprising determining the presence, in a biological sample from said mammal, preferably in a blood (derivative) sample, of an alteration in one or more genes or RNAs comprising a sequence chosen from among SEQ ID Nos.: 1 to 5578, the presence of such an alteration being indicative of the risk of developing Alzheimer's disease in said mammal.

Another object of the invention concerns a method for evaluating or monitoring the response to a treatment for Alzheimer's disease, comprising a step of measuring the expression of one or, preferably, several genes or RNAs comprising a sequence chosen from among SEQ ID Nos.: 1 to 5578 before and/or during the treatment, and a comparison of the expression thus measured to the one measured at an earlier stage of the treatment or at the treatment.

Another object of the invention concerns an improvement to the methods for treating Alzheimer's disease, the improvement comprising measuring the expression of one or, preferably, several genes or RNAs comprising a sequence chosen from among SEQ ID Nos.: 1 to 5578 in a subject before and/or during the treatment. Measuring expression allows adjusting the treatment as a function of disease progression. The treatment is typically a treatment by acetylcholinesterase inhibitors such as galantamine, donepezil and rivastigmine.

Another object of the invention concerns the use of an acetylcholinesterase inhibitor, such as galantamine, donepezil and rivastigmine, for the preparation of a drug to treat Alzheimer's disease in a patient with deregulation of the expression of (at least) one gene such as defined previously.

Alteration in a gene or RNA means, in the sense of the invention, (i) any change in expression, i.e., in particular, a deregulation in the expression (e.g., transcription or translation) level, a deregulation in splicing, leading, for example, to the appearance of particular splice forms or a change in the (relative) quantity or ratio between different splice forms, as well as (ii) any change in the structure of the protein produced (appearance or disappearance of truncated, elongated or mutated forms, etc.).

As it will be described in the following text, the present application describes the identification of splicing deregulations in certain genes in the blood of patients with Alzheimer's disease. Any molecule or technique permitting to measure the expression of these genes in the blood can be implemented in the scope of the present invention, such as nucleotide primers, nucleotide probes or specific antibodies, which can be in suspension or in the immobilized form, as it will be described in detail in the following text.

Thus, another object of the present application concerns a product comprising a support on which are immobilized nucleic acids containing a sequence complementary and/or specific for one or, preferably, several genes or RNAs such as defined previously. Preferably, the product comprises distinct nucleic acids comprising a sequence complementary and/or specific for at least 5, 10, 20, 30, 40, 50, 60 or more genes or RNAs such as previously defined.

Another object of the present application concerns a product comprising a support on which is immobilized at least one ligand for a polypeptide coded by a gene or RNA such as defined above. Preferably, the product comprises at least 5, 10, 20, 30, 40, 50, 60 or more ligands of different polypeptides chosen from among the polypeptides mentioned above.

Another object of the present invention concerns a kit comprising a compartment or container comprising at least one, preferably several, nucleic acids comprising a sequence complementary and/or specific for one or more genes or RNAs such as defined previously and/or one, preferably several, ligands for one or more polypeptides such as defined previously. Preferably, the product comprises at least 5, 10, 20, 30, 40, 50, 60 or more different nucleic acids and/or ligands chosen from among the nucleic acids and ligands mentioned above. The kit can also comprise reagents for a hybridization or immunological reaction, as well as, if applicable, controls and/or instructions.

Another object of the invention concerns the use of a product or kit such as defined above for the detection of Alzheimer's disease in a mammalian subject, preferably a human subject.

Another object of the invention concerns the use of a product or kit such as defined above for the determination of the risk of developing Alzheimer's disease in a mammalian subject, preferably a human subject, in particular in a subject with mild cognitive impairment or at asymptomatic stages of Alzheimer's, in particular of the hippocampal or amnesic type.

Another object of the invention concerns the use of a product or kit such as defined above to discriminate subjects with Alzheimer's disease from subjects with mild cognitive impairment.

Another object of the invention concerns the use of a product or kit such as defined above to determine the response to a treatment for Alzheimer's disease or for the selection of subjects likely to effectively respond to a treatment.

Another object of the invention concerns a method for detecting or screening for Alzheimer's disease, comprising determining the presence of one or more target molecules chosen from among:
   a) nucleic acids containing at least one pair of sequences defined in Table 2 or a fragment thereof having at least 15, preferably at least 16, 17, 18, 19, 20, 25 or 30 consecutive bases,
   b) nucleic acids having a sequence complementary to a sequence according to a),
   c) functional analogs of nucleic acids according to a) or b), or
   d) polypeptides coded by nucleic acids according to a) to c).

Another object of the invention resides in an isolated nucleic acid comprising a sequence chosen from among SEQ ID Nos: 1 to 5578 or a fragment thereof having at least 15, 16, 17, 18, 19 or 20 consecutive bases, or a sequence complementary thereto. Preferably, the nucleic acid of the invention does not comprise the complete sequence of a natural gene or RNA. Preferably, it includes no more than 500 bases, preferably no more than 400 or 300 bases. The nucleic acid of the invention is typically synthetic, i.e., produced by non-natural pathways (recombinant, in vitro, chemical synthesis, etc.).

Another object of the invention is a polypeptide encoded by a nucleic acid such as defined above.

Serum Markers for Alzheimer's Disease

The present invention relies on the detection and characterization of serum biological events characteristic of Alzheimer's disease in a human patient. These events represent biomarkers, whose detection in a patient, preferably in combination, allows determining, even at an early stage, the risk of developing such a disease, the presence of such a disease, or the stage of progression of this disease. Moreover, the markers according to the invention are also usable to measure the response to a treatment and/or to select candidate drugs. The combinations of markers of the invention can distinguish Alzheimer's disease from other neurodegenerative diseases.

The biological events identified typically correspond to changes in the regulation of gene expression. It can be a matter of partial or total inhibition of the expression of genes or RNA, or certain forms of genes or RNA, an increase in the expression of genes or certain forms of genes or RNA, the appearance or disappearance of gene splice forms, etc.

The invention therefore relies on the detection in a sample of one or more target molecules advantageously chosen from among:

a) nucleic acids containing a sequence chosen from among SEQ ID NOs: 1-5578, or a distinctive fragment thereof having at least 15, preferably at least 16, 17, 18, 19, 20, 25 or 30 consecutive bases.

b) nucleic acids having a sequence complementary to a sequence according to a), c) functional analogs of nucleic acids according to a) or b), or d) polypeptides coded by nucleic acids according to a) to c).

The term "functional analog" preferably designates a polymorphic variant of SEQ ID NO: 1-5578 present in the human population. In the majority of cases, these polymorphisms are represented by point variations at the base level, although other polymorphic configurations also exist. These analogs may be identified by any technique known to the person skilled in the art, particularly in consideration of the sequences provided in the application and the names of the corresponding genes. The term analog also includes sequences originating from another mammalian species. In fact, the genes corresponding to SEQ ID NO: 1-5578 are human genes, and these sequences constitute effective and appropriate markers for the detection of Alzheimer's disease in human patients. However, for applying the methods of the invention to other mammalian species, it is generally preferable to use functional analogs of these sequences, characterized in the species in question.

In one particular embodiment, the method comprises determining the presence (or the absence or a variation in the expression level) of at least one nucleic acid according to a) to c).

In one particular embodiment, the method is used to detect Alzheimer's disease in a human subject and comprises determining the presence (or the absence or a variation in the expression level) of at least one nucleic acid according to a) to c).

In one particular variant, the method comprises the combined determination of the presence of absence or (relative) quantity of at least 5, 10, 15, 20, 30, 40, 50, 60, 70 or more target molecules such as defined above. "Combined" determination means that a hybridization profile (or a signature) involving several markers is determined. Combined determination is typically done simultaneously, i.e., by an overall measurement of an expression profile. However, combined determination can also be done by parallel or sequential measurements of several markers, leading to identifying a profile. The invention allows establishing and determining a hybridization profile (or a signature) on a collection of markers, in order to evaluate the presence or risk of developing Alzheimer's disease in a mammal The hybridization profile is typically made by using a combination of several markers chosen from among the targets indicated above, for example containing all these targets.

In one particular embodiment, the method of the invention comprises determining the presence (or the absence or the (relative) quantity), in a biological sample from the mammal, of at least 5 distinct target molecules chosen from among those defined above, preferably at least 10.

In preferred embodiments, the method of the invention comprises the combined determination of the presence (or the absence or the (relative) quantity), in a biological sample from the mammal, of particular subsets of target molecules chosen from among those defined above. Such subsets, described in the examples, are particularly suited to the detection, especially in the early phase, of the presence of Alzheimer's disease in patients from a whole blood sample.

Thus, in one particular embodiment, the method of the invention comprises the combined determination of the presence (or the absence or the (relative) quantity), in a biological sample from the mammal, of the nucleic acids of an entire panel of targets (or signatures) comprising markers such as defined in a) to d) above, preferably of all the molecules of one of panels 1 to 60 defined in the present application.

Thus, in one particular embodiment, the method of the invention comprises the combined determination of the presence (or the absence or the (relative) quantity), in a biological sample from the mammal, of all the nucleic acids of one of Panels 1 to 60 comprising the sequences shown in Table 1, columns G to BN, respectively, or a distinctive fragment thereof having at least 15, preferably at least 16, 17, 18, 19, 20, 25 or 30 consecutive bases, or having a sequence complementary thereto and/or functional analogs thereof originating from other species, and/or polypeptides encoded by these nucleic acids. The examples provided in the present application show that this marker panel allows predictively detecting the presence, the risk of developing, or the stage of progression of Alzheimer's disease. In one particular embodiment, the method also comprises the detection of one or more other target molecules such as previously defined.

In a specific embodiment, the method of the invention comprises determining the presence (or the absence or the (relative) quantity), in a mammalian biological sample, of nucleic acids respectively comprising the sequences shown in SEQ ID NOs: 1-5578, or a distinctive fragment thereof having at least 15, preferably at least 16, 17, 18, 19, 20, 25 or 30 consecutive bases, or nucleic acids having a sequence complementary thereto.

Another particular object of the invention resides in a method for detecting the presence or risk of developing Alzheimer's disease in a mammal, comprising contacting, under conditions allowing hybridization between complementary sequences, nucleic acids from a blood sample of the mammal and a set of probes specific for the following target molecules:

a) nucleic acids comprising the sequences shown in any one of PANELS1 to 60 such as defined above, or a distinctive fragment thereof having at least 15, preferably at least 16, 17, 18, 19, 20, 25 or 30 consecutive bases, and/or b) nucleic acids having a sequence complementary to sequences according to a), and/or c) functional analogs of nucleic acids according to a) or b) coming from another species, in order to obtain a hybridization profile, the hybridization profile being characteristic of the presence or risk of developing Alzheimer's disease in said mammal.

Another particular object of the invention resides in a method for detecting the risk of developing Alzheimer's disease in a mammal presenting mild cognitive impairment, or in an asymptomatic mammal, or to discriminate patients with Alzheimer's from patients with mild cognitive impairment, comprising contacting, under conditions allowing hybridization between complementary sequences, nucleic acids from a blood sample from the mammalian and a probe set, the probe set comprising at least one probe comprising all or part of each of the nucleic acid sequences of one of the following panels, or their complementary sequence:

set 1: 6PS
set 2: 27PS in order to obtain a hybridization profile, the hybridization profile being characteristic of the presence or risk of developing Alzheimer's disease in this mammal.

Another object of the invention resides in the use of a probe set, the probe set comprising at least one probe comprising all or part of each of the nucleic acid sequences of one of the following panels, or their complementary sequence:
set 1: 6PS
set 2: 27PS
to detect the presence or the risk of developing Alzheimer's disease in a subject with mild cognitive impairment, or in an asymptomatic subject, or to discriminate subjects with Alzheimer's from subjects with mild cognitive impairment.

Another particular object of the invention is a method for detecting the presence or risk of developing Alzheimer's disease in a mammal, comprising contacting, under conditions allowing hybridization between complementary sequences, nucleic acids from a blood sample from the mammalian and a probe set, the probe set comprising at least one probe comprising all or part of each of the nucleic sequences of the following panel, or their complementary sequence:
set 3: 18PS
in order to obtain a hybridization profile, the hybridization profile being characteristic of the presence or risk of developing Alzheimer's disease in said mammal.

Another object of the invention is the use of a probe set, the probe set comprising at least one probe comprising all or part of each of the nucleic acid sequences of one of the following panels, or their complementary sequence:
set 3: 18PS
for detecting the presence or the risk of developing Alzheimer's disease in a subject.

Another object of the invention is a method for detecting the presence or the risk of developing Alzheimer's disease in a mammal, or for discriminating patients with Alzheimer's disease from subjects with mild cognitive impairment or control subjects, the method comprising detecting, from a blood sample of said mammal, a variation in the levels of nucleic acids complementary of a probe set, the probe set comprising at least one probe comprising all or part of each of the nucleic sequences of one of the following panels, or their complementary sequence:
set 1: 6PS
set 2: 27PS
set 3: 18PS
set 4: 33 PS
a variation being characteristic of the presence or risk of developing Alzheimer's disease in said mammal.

The invention also allows defining additional panels, containing at least some markers such as defined previously, which may possibly be combined with other markers. Such panels may be obtained by testing for the presence or absence of these markers in patient samples, in order to define other predictive combinations, if applicable, specific for particular pathologies.

Methods for Detecting an Alteration in a Gene

As previously indicated, an alteration in a gene or RNA means, in the sense of the invention, (i) any change in expression, i.e., in particular, a deregulation in the level of expression (e.g., transcription or translation), a deregulation in splicing, leading to, for example, the appearance of particular splice forms or a change in the (relative) quantity or ratio between the different splice forms, as well as (ii) any change in the structure of the protein produced (appearance or disappearance of truncated, elongated or mutated forms, etc.).

Various techniques allowing the detection of a nucleic acid species in a sample can be used in the present invention, such as, for example, Northern blot, selective hybridization, the use of supports coated with oligonucleotide probes, amplification of the nucleic acid by RT-PCR, quantitative PCR or ligation-PCR, etc. These methods can comprise the use of a nucleic acid probe (for example an oligonucleotide) that can selectively or specifically detect the target nucleic acid in the sample. Amplification can be done according to various methods known in themselves to the person skilled in the art, such as PCR, LCR, transcription-mediated amplification (TMA), strand-displacement amplification (SDA), NASBA, the use of allele-specific oligonucleotides (ASO), allele-specific amplification, Southern blot, single-strand conformational analysis (SSCA), in-situ hybridization (e.g., FISH), migration on a gel, heteroduplex analysis, etc. If necessary, the quantity of nucleic acid detected can be compared to a reference value, for example a median or mean value observed in patients who do not have Alzheimer's disease, or to a value measured in parallel in a control sample. Thus, it is possible to demonstrate a variation in the level of expression.

According to one preferred embodiment, the method comprises detecting the presence or absence or (relative) quantity of a nucleic acid according to a) to c) by selective hybridization or selective amplification.

Selective hybridization is typically done by using nucleic probes, preferably immobilized on a support, such as a solid or semi-solid support with at least one surface, flat or not, for immobilizing nucleic acid probes. Such supports are, for example, a slide, bead, membrane, filter, column, plate, etc. They can be made of any compatible material, such as, notably, glass, silica, plastic, fiber, metal, polymer, etc. The nucleic acid probes can be any nucleic acid (DNA, RNA, PNA, etc.), preferably single strand, comprising a sequence specific for a target molecule such as defined in a) to c) above. The probes typically contain 5 to 400 bases, preferably 8 to 200, more preferentially less than 100, and still more preferentially, less than 75, 60, 50, 40 or even 30 bases. The probes can be synthetic oligonucleotides, produced based on sequences SEQ ID NO: 1-5578 (target sequences) of the invention, according to conventional synthesis techniques. Such oligonucleotides typically have 10 to 50 bases, preferably 20 to 40 bases, for example, approximately 25 bases. In one particularly advantageous embodiment, so as to improve the signal detected, several different oligonucleotides (or probes) defined from a same target sequence are used to detect the same target molecule (transcript from the amplification of patient RNA) during hybridization. It can be oligonucleotides specific for different regions of the same target sequence, or centered differently on the same region. Advantageously probe sets containing 1-3 probes are used, which can be overlapping or not, completely or partially, and which are specific for the same target molecule. Probe pairs can also be used, one member of which is perfectly matched to the target sequence, and the other having a mismatch, thereby estimating background noise. The probes can be designed to hybridize to an exon or intron region, or an exon-exon, exon-intron or intron-intron junction region. Thus, the probes allow detecting and distinguishing different splice forms of a gene.

In one preferred embodiment, probes are used whose sequence comprises all or part of a nucleic acid sequence chosen from among SEQ ID NOs: 1-5578 or a complementary sequence thereof. In a preferred embodiment, nucleic acid probes are used with a length comprised between 15 and 50 bases, more preferentially between 15 and 40 bases, and whose sequence is identical to a fragment of a sequence chosen from among SEQ ID NO: 1-5578 or a complementary sequence thereof.

In one particularly preferred embodiment, probe sets are used, i.e., sets of 1-3 probes each containing a part, overlapping or not, of the same nucleic acid sequence chosen from among SEQ ID NOs: 1-5578.

The probes can be synthesized beforehand then deposited on the support, or synthesized directly in situ, on the support, according to methods known per se to the person skilled in the art. The probes can also be fabricated by genetic techniques, for example by amplification, recombination, ligation, etc.

The probes thus defined represent another object of the present application, as well as their use (essentially in vitro) for the detection of Alzheimer's disease in a subject.

Hybridization can be done under conventional conditions, known to the person skilled in the art and adjustable by this person (Sambrook, Fritsch, Maniatis (1989) Molecular Cloning, Cold Spring Harbor Laboratory Press). In particular, hybridization can be done under high, medium or low stringency conditions, according to the level of sensitivity sought, the quantity of material available, etc. For example, appropriate hybridization conditions include a temperature comprised between 55 and 63° C. for 2 to 18 hours. Other hybridization conditions, suitable for high density supports, are, for example, a hybridization temperature between 45 and 55° C. After hybridization, various washings can be done to eliminate the non-hybridized molecules, typically in SSC buffers containing SDS, such as a buffer containing 0.1 to 10×SSC and 0.5-0.01% SDS. Other washing buffers containing SSPE, MES, NaCl or EDTA can also be used.

In a typical embodiment, nucleic acids (or chips or supports) are pre-hybridized in a hybridization buffer (Rapid Hybrid Buffer, Amersham) typically containing 100 μg/mL DNA from salmon sperm at 65° C. for 30 min. The nucleic acids of the sample are then contacted with the probes (typically applied onto the support or chip) at 65° C. for 2 to 18 hours. Preferably, the nucleic acids of the sample are labeled beforehand, by any known label (radioactive, enzymatic, fluorescent, luminescent, etc.). The supports are then washed in a 5×SSC, 0.1% SDS buffer at 65° C. for 30 min, then in a 0.2×SSC, 0.1% SDS buffer. The hybridization profile is analyzed by conventional techniques, such as, for example, by measuring the labeling on the support by means of a suitable instrument (for example InstantImager, Packard Instruments). The hybridization conditions can naturally be adjusted by the person skilled in the art, for example by modifying the hybridization temperature and/or the saline concentration of the buffer as well as by adding auxiliary substances such as formamide or single-strand DNA.

A particular object of the invention is thus a method for detecting the presence or the risk of developing Alzheimer's disease in a mammal, or for evaluating the response to a treatment for Alzheimer's disease, comprising contacting, under conditions allowing hybridization between complementary sequences, nucleic acids from a blood sample from the mammal and a set of probes specific for the target molecules as identified above, to obtain a hybridization profile, the hybridization profile being characteristic of the presence or risk of developing Alzheimer's disease in this mammal, or the efficacy of treatment.

A particular object of the invention thus resides in a method for detecting the presence or risk of developing Alzheimer's disease in a mammal, comprising contacting, under conditions allowing hybridization between complementary sequences, nucleic acids from a blood sample from the mammal and a set of probes specific for at least the following target molecules:
a) nucleic acids comprising the sequences shown in panels 1 to 60 defined previously, or a distinctive fragment thereof having at least 15, preferably at least 16, 17, 18, 19, 20, 25 or 30 consecutive bases, and/or
b) nucleic acids having a sequence complementary to a sequence according to a), and/or
c) functional analogs of nucleic acids according to a) or b) originating from another species, in order to obtain a hybridization profile, the hybridization profile being characteristic of the presence or risk of developing Alzheimer's disease in this mammal.

In particular embodiments, the processes of the invention also use other target molecules and/or other probes, particularly the target molecule subset mentioned in the present application.

Thus, another particular object of the invention is a method for detecting the presence or risk of developing Alzheimer's disease in a mammal, comprising contacting, under conditions allowing hybridization between complementary sequences, nucleic acids from a blood sample from the mammal and a set of probes specific for at least two different molecules chosen from among the following targets:
a) nucleic acids containing a sequence chosen from among SEQ ID NOs: 1-5578, or a distinctive fragment thereof having at least 15, preferably at least 16, 17, 18, 19, 20, 25 or 30 consecutive bases and/or
b) nucleic acids having a sequence complementary to a sequence according to a), and/or
c) functional analogs of nucleic acids according to a) or b) coming from another species, in order to obtain a hybridization profile, the hybridization profile being characteristic of the presence or risk of developing Alzheimer's disease in this mammal.

Another particular object of the invention resides in a method for detecting the presence or risk of developing Alzheimer's disease in a mammal, comprising contacting, under conditions allowing hybridization between complementary sequences, nucleic acids from a blood sample from the mammal and a probe set, the probe set comprising at least one probe comprising all or part of each of the nucleic sequences of one of the following panels, or their complementary sequence:
set 1: 6PS
set 2: 27PS
set 3: 18PS
set 4: 33 PS in order to obtain a hybridization profile, the hybridization profile being characteristic of the presence or risk of developing Alzheimer's disease in this mammal.

As explained in more detail in the experimental part (see example 11), set 1 thus comprises at least the following 6 probes:
a probe comprising all or part of the sequence SEQ ID NO: 2363 or its complementary sequence;
a probe comprising all or part of the sequence SEQ ID NO: 2364 or its complementary sequence;
a probe comprising all or part of the sequence SEQ ID NO: 5307 or its complementary sequence;
a probe comprising all or part of the sequence SEQ ID NO: 5426 or its complementary sequence;
a probe comprising all or part of the sequence SEQ ID NO: 4218 or its complementary sequence;
a probe comprising all or part of the sequence SEQ ID NO: 5063 or its complementary sequence.

As indicated previously, the term "part" advantageously designates a region from 15 to 50 consecutive nucleotides.

In one particular embodiment, set 1 comprises:
from 1 to 3 probes, overlapping or not, each comprising all or part of sequence SEQ ID NO: 2363 or its complementary sequence;
from 1 to 3 probes, overlapping or not, each comprising all or part of sequence SEQ ID NO: 2364 or its complementary sequence;

from 1 to 3 probes, overlapping or not, each comprising all or part of sequence SEQ ID NO: 5307 or its complementary sequence;

from 1 to 3 probes, overlapping or not, each comprising all or part of sequence SEQ ID NO: 5426 or its complementary sequence;

from 1 to 3 probes, overlapping or not, each comprising all or part of sequence SEQ ID NO: 4218 or its complementary sequence; and from 1 to 3 probes, overlapping or not, each comprising all or part of sequence SEQ ID NO: 5063 or its complementary sequence.

It is understood that set 1 can contain, in addition to the 6 probes or groups of probes (probe sets) cited, other probes or probe sets, containing, for example, a sequence chosen from among SEQ ID NO: 1-5578 and/or from among other sequences.

Sets 2-4 can be defined like set 1 above. The base probes constituting these sets are given in Example 11.

Another particular object of the invention resides in a method to detect the risk of developing Alzheimer's disease in a mammal presenting mild cognitive impairment, or an asymptomatic one, or to discriminate patients with Alzheimer's from patients with mild cognitive impairment, comprising contacting, under conditions allowing hybridization between complementary sequences, nucleic acids from a blood sample from the mammal and a probe set, the probe set containing several probes comprising at least one probe comprising all or part of each of the nucleic acid sequences of one of the following panels, or their complementary sequence:

set 1: 6PS
set 2: 27PS in order to obtain a hybridization profile, the hybridization profile being characteristic of the presence or risk of developing Alzheimer's disease in this mammal.

Another object of the invention resides in the use of a set of (groups of) probes, the set comprising several (groups of) probes, including at least one probe (or a group of probes) comprising all or part of each of the nucleic acid sequences of one of the following panels, or their complementary sequence:

set 1: 6PS
set 2: 27PS to detect the presence or the risk of developing Alzheimer's disease in a subject with mild cognitive impairment, or an asymptomatic one, or to discriminate subjects with Alzheimer's from subjects with mild cognitive impairment.

The possibility of distinguishing, in patients with mild cognitive impairment (MCI) or asymptomatic patients, those who have Alzheimer's or are likely to develop Alzheimer's is particularly important because it allows quickly initiating the most suitable treatment. Thirty to forty percent of subjects with MCI will progress to AD. The possibility of identifying these subjects from the MCI stage allows initiating effective treatment protocols for AD without waiting for the disease to progress.

Another particular object of the invention is a method for detecting the risk of developing Alzheimer's disease in a mammal, comprising contacting, under conditions allowing hybridization between complementary sequences, nucleic acids from a blood sample from the mammal and a probe set, the probe set comprising at least one probe comprising all or part of each of the nucleic acid sequences of the following panel, or their complementary sequence:

set 3: 18PS in order to obtain a hybridization profile, the hybridization profile being characteristic of the presence or risk of developing Alzheimer's disease in this mammal.

Another object of the invention is the use of a set of (groups of) probes, comprising at least one probe (or group of probes) comprising all or part of each of the nucleic acid sequences of the following panel, or their complementary sequence:

set 3: 18PS for detecting the presence or the risk of developing Alzheimer's disease in a subject.

Another object of the invention is a method for detecting the presence or the risk of developing Alzheimer's disease in a mammal, or for discriminating patients with Alzheimer's from subjects with mild cognitive disorders or control subjects, comprising detecting, from a mammalian blood sample, a variation in the levels of complementary nucleic acids of a probe set, the probe set containing at least one probe comprising all or part of each of the nucleic sequences of one of the following panels, or their complementary sequence:

set 1: 6PS
set 2: 27PS
set 3: 18PS
set 4: 33 PS a variation being characteristic of the presence or risk of developing Alzheimer's disease in this mammal.

The hybridization profile can be compared to one or more reference profiles, notably a reference profile characteristic of healthy subjects and/or subjects with Alzheimer's disease, the comparison allowing determining the probability or risk that the patient tested has of getting Alzheimer's disease. Typically, the comparison is done by means of computer programs known in themselves to the person skilled in the art.

Selective amplification is preferably done by using a primer or pair of primers for amplifying all or part of the target nucleic acids in the sample, when it is present. The primer can be specific for a target sequence such as defined previously according to SEQ ID NO: 1-5578, or a region flanking the target sequence in a nucleic acid of the sample. The primer typically contains a single-strand nucleic acid, of a length advantageously comprised between 5 and 50 bases, preferably between 5 and 30. Such a probe constitutes another object of the present application, as well as its use (essentially in vitro) for the detection of Alzheimer's disease in a subject. The primers can be designed to hybridize to an exon or intron region, or an exon-exon, exon-intron or intron-intron junction region. Thus, the primers allow detecting and distinguishing the different splice forms of a gene.

In this regard, another object of the invention is the use of a nucleotide primer or a set of nucleotide primers amplifying all or part of one or, or preferably several genes or RNAs containing a target sequence according to SEQ ID NO: 1-5578, for detecting the presence or the risk of developing Alzheimer's disease in a mammal, or to evaluate the response to an Alzheimer's disease treatment in a mammal, particularly in a human being.

Another particular object of the invention is a method for detecting the presence or risk of developing Alzheimer's disease in a mammal, comprising contacting, under conditions allowing amplification, nucleic acids from a blood sample from the mammal and a set of primers specific for at least two different molecules chosen from among the following targets:

a) nucleic acids comprising a sequence chosen from among SEQ ID NOs: 1-5578, or a distinctive fragment thereof having at least 15, preferably at least 16, 17, 18, 19, 20, 25 or 30 consecutive bases and/or b) nucleic acids having a sequence complementary to a sequence according to a), and/or c) functional analogs of nucleic acids according to a) or b) originating from another species, in order to obtain an amplification profile, the amplification profile being characteristic of the presence or risk of developing Alzheimer's disease in this mammal.

Detection of an Alteration in a Polypeptide

In another embodiment, the method comprises determining the presence or (relative) quantity of a polypeptide coded by a gene such as previously defined. The detection or assay of a polypeptide in a sample can be done by any known technique, such as, notably, by means of a specific ligand, for example an antibody or an antibody fragment or derivative. Preferably, the ligand is an antibody specific for the polypeptide, or a fragment of such an antibody (for example a Fab, Fab', CDR, etc.), or a derivative of such an antibody (for example, a single-chain antibody, ScFv). The ligand is typically immobilized on a support, such as a slide, ball, column, plate, etc. The presence or the quantity of the target polypeptide in the sample can be detected by detecting a complex between the target and the ligand, for example by using a labeled ligand, by using a second labeled visualization ligand, etc. Well known and usable immunological techniques are ELISA, RIA, etc. If necessary, the quantity of polypeptide detected can be compared to a reference value, for example a median or mean value observed in patients who do not have Alzheimer's disease, or to a value measured in parallel in a control sample. Thus, it is possible to demonstrate a variation of the expression level.

Antibodies specific for the target polypeptides can be produced by conventional techniques, notably by immunizing a non-human animal with an immunogen containing the polypeptide (or an immunogenic fragment thereof), and recovering (polyclonal) antibodies or producing cells (to produce monoclonals). Techniques for producing poly- or monoclonal antibodies, ScFv fragments, and human or humanized antibodies are described, for example in Harlow et al., Antibodies: A Laboratory Manual, CSH Press, 1988; Ward et al., Nature 341 (1989) 544; Bird et al., Science 242 (1988) 423; WO94/02602; U.S. Pat. Nos. 5,223,409; 5,877,293; WO93/01288. The immunogen can be fabricated by synthesis or by expression, in an appropriate host, of a target nucleic acid such as defined above. Such an antibody, monoclonal or polyclonal, as well as its derivatives having the same antigenic specificity, also constitute a object of the present application, as well as their use for detecting Alzheimer's disease.

Changes in the expression and/or the structure of proteins can also be detected by means of techniques known in themselves to the person skilled in the art and involving mass spectroscopy, more generally grouped under the name proteomic analysis, in order to detect specific signatures from the blood of patients with Alzheimer's disease.

Implementation of the Process

The method of the invention is applicable to any tested mammalian biological sample, in particular any sample containing nucleic acids or polypeptides. Advantageously, we can mention a blood, plasma, platelet, saliva, urine, stool, etc. sample, or more generally, any tissue, organ or, advantageously, biological fluid containing nucleic acids or polypeptides.

In one preferred and particularly advantageous embodiment, the sample is a sample derived from blood, for example a blood, serum or plasma sample. The invention identifies blood markers for Alzheimer's disease, and thus allows detecting this disease without tissue biopsy, requiring only blood samples.

The sample can be obtained by any technique known per se, for example, by taking samples, by non-invasive techniques, from sample collections or banks, etc. The sample can also be pretreated to facilitate the accessibility of the target molecules, for example by lysis (mechanical, chemical, enzymatic, etc.), purification, centrifugation, separation, etc. The sample can also be labeled, to facilitate the determination of the presence of target molecules (fluorescent, radioactive, luminescent, chemical, enzymatic, etc. labeling). The nucleic acids of the sample can also be separated, treated, enriched, purified, retrotranscribed, amplified, and fragmented. In one particular embodiment, the nucleic acids of the sample are RNAs, notably the mRNAs of the sample. In another particular embodiment, the nucleic acids are the product of RNA amplification, notably mRNAs, or cDNAs prepared from RNA, notably the mRNAs of the sample.

In one preferred embodiment, the biological sample is a whole blood sample, i.e., it has not undergone a separation step, which may be diluted.

The invention can be applied to any mammal, preferably to humans. The method of the invention is particularly useful for the detection of Alzheimer's disease, notably the presence, risk of development, or degree of severity/advancement of Alzheimer's disease in the human being. Thus, the data provided in the examples show that the invention detects the presence of Alzheimer's disease with a sensitivity greater than 95% and a specificity greater than 95%.

One particular object of the present invention concerns a method for detecting the presence, the progression, or the risk of developing Alzheimer's disease in a human subject, comprising the combined determination of the presence (or absence or (relative) quantity), in a biological sample from a human subject, of target molecules chosen from among:

a) nucleic acids containing a sequence chosen from among SEQ ID Nos: 1-5578, or a distinctive fragment thereof having at least 15, preferably at least 16, 17, 18, 19, 20, 25 or 30 consecutive bases, b) nucleic acids having a sequence complementary to a sequence according to a), and c) polypeptides coded by nucleic acids according to a) or b).

Preferably, the method comprises the combined determination of the presence, absence or quantity of 5, 10, 20, 30, 40, 50 or 60 target molecules such as defined above.

Another particular object of the present application concerns a method for detecting the presence, the progression, or the risk of developing Alzheimer's disease in a human subject, comprising contacting a biological sample from the subject containing nucleic acids with a product containing a support on which are immobilized nucleic acids containing a sequence complementary and/or specific for one or, preferably, several target molecules chosen from among (i) nucleic acids containing a sequence chosen from among SEQ ID NO: 1-5578, or a fragment thereof having at least 15, preferably at least 16, 17, 18, 19, 20, 25 or 30 consecutive bases and (ii) nucleic acids having a sequence complementary to a sequence according to (i), and the profile indicating the presence, the degree of severity/advancement or the risk of developing Alzheimer's disease in said human subject. Preferably, the product contains distinct nucleic acids comprising a sequence complementary and/or specific for at least 5, 10, 20, 30, 40, 50, 60 or more genes or RNAs such as discussed above.

Another object of the present application concerns a product comprising a support on which are immobilized nucleic acids containing a sequence complementary and/or specific for one or, preferably, several target molecules chosen from among (i) nucleic acids containing a sequence chosen from among SEQ ID NO: 1-5578, or a fragment thereof having at least 15, preferably at least 16, 17, 18, 19, 20, 25 or 30 consecutive bases and (ii) nucleic acids having a sequence complementary to a sequence according to (i). Preferably, the product contains distinct nucleic acids comprising a complementary and/or specific sequence for at least 5, 10, 20, 30, 40, 50, 60 or more genes or RNAs such as previously defined.

Another object of the present application concerns a product containing a support on which is immobilized at least one, preferably several, nucleic acids containing a sequence chosen from among SEQ ID NO: 1-5578 or a functional analog thereof. Preferably, the product contains at least 5, 10, 20, 30, 40, 50, 60 or more different nucleic acids chosen from among the nucleic acids mentioned above.

Another object of the present application concerns a product comprising a support on which is immobilized a probe set, the probe set containing several probes, at least one of which comprises all or part of each of the nucleic acid sequences of one of the following panels, or their complementary sequence:
  set 1: 6PS,
  set 2: 27PS
  set 3: 18PS, or
  set 4: 33PS.

Another object of the present application concerns a product comprising a support on which is immobilized at least one ligand for a polypeptide coded by a target nucleic acid such as defined above, i.e., a nucleic acid containing a sequence chosen from among SEQ ID NO: 1-5578, or a distinctive fragment thereof, having at least 15, preferably at least 16, 17, 18, 19, 20, 25 or 30 consecutive bases, a nucleic acid having a sequence complementary thereto or a functional analog thereof. Preferably, the product comprises at least 5, 10, 20, 30, 40, 50, 60 or more ligands of different polypeptides chosen from among the polypeptides mentioned above.

The support can be any solid or semi-solid support having at least one surface, flat or not (i.e., in 2 or 3 dimensions), allowing immobilizing nucleic acids or polypeptides. Such supports are, for example, a slide, bead, membrane, filter, column, plate, etc. They can be made of any compatible material, such as, notably, glass, silica, plastic, fiber, metal, polymer, polystyrene, Teflon, etc. The reagents can be immobilized on the support surface by known techniques, or in the case of nucleic acids, synthesized directly in situ on the support. Immobilization techniques include passive adsorption (Inouye et al., J. Clin. Microbiol. 28 (1990) 1469) and covalent bonding. Some techniques are described, for example, in WO90/03382 and WO99/46403. The reagents immobilized on the support can be arranged according to a pre-established plan, in order to facilitate the detection and identification of the complexes formed, and according to a variable and adaptable density.

In one embodiment, the product of the invention contains several synthetic oligonucleotides, of a length comprised between 5 and 100 bases, specific for one or more genes or RNAs such as previously defined.

The products of the invention typically contain control molecules for calibrating and/or standardizing the results.

Another object of the present application concerns a product containing a support on which are immobilized nucleic acids comprising all or part of sequences chosen from among SEQ ID NO: 5579-21559. These sequences represent specific probes for SEQ ID NO: 1-5578. Such a product can advantageously incorporate nucleic acids chosen for their nondiscriminating nature for the population of patients with Alzheimer's disease, such as nucleic acids serving as standardization controls for the product. These nucleic acids can correspond to all or part of sequences chosen from among SEQ ID NO: 21560-51087.

Another object of the present application concerns a kit containing a compartment or container comprising at least one, preferably several, nucleic acids comprising a complementary and/or specific sequence for one or more genes or RNAs such as defined previously and/or one, or preferably several, ligands for one or more polypeptides such as defined previously. Preferably, the product contains at least 5, 10, 20, 30, 40, 50, 60 or more different nucleic acids and/or ligands chosen from among the nucleic acids and ligands mentioned above. In one particular embodiment, the product contains each of the nucleic acids of sequence SEQ ID NO: 1-5578 or a ligand for each of the target polypeptides such as defined above. In another particular embodiment, the product contains each of the nucleic acids of sequence SEQ ID NO: 5579-51087. The kit can also include reagents for a hybridization or immunological reaction, as well as, if applicable, controls and/or instructions.

Another object of the invention concerns the use of a product or kit such as defined above for the detection of Alzheimer's disease in a mammalian subject, preferably a human subject.

Another object of the invention concerns a nucleic acid having a sequence chosen from among SEQ ID NO: 1-5578, or a distinctive fragment thereof, containing at least 15, preferably at least 16, 17, 18, 19, 20, 25 or 30 consecutive bases, or a nucleic acid having a sequence complementary thereto or a functional analog thereof. The invention also concerns a cloning or expression vector containing these nucleic acids, as well as any recombinant cell containing such a vector or nucleic acid.

Another object of the invention concerns the use of a nucleic acid containing a sequence chosen from among SEQ ID NO: 1-5578, or a distinctive fragment thereof, containing at least 15, preferably at least 16, 17, 18, 19, 20, 25 or 30 consecutive bases, or a nucleic acid having a complementary sequence thereof or a functional analog thereof, for the detection (essentially in vitro) of Alzheimer's disease in a mammalian subject.

According to one particular embodiment of the invention, a blood sample is taken from the mammal to be tested. The blood sample may be treated so as to make the nucleic acids more accessible, and these nucleic acids are labeled. The nucleic acids are then applied onto a product such as defined above and the hybridization profile is determined, permitting diagnosing whether Alzheimer's disease is present in the subject or not. The method of the invention is simple, practiced ex vivo, and permits early detection of Alzheimer's disease from a blood sample.

It is understood that any equivalent technique can be used in the scope of the present application to determine the presence of a target molecule.

Other aspects and advantages of the present invention will appear upon reading the examples that follow, which should be considered as illustrative and non-limiting.

FIGURE LEGEND

FIG. 1. Configuration of the probes present on the GWSA microarray. A) B, F, and T exon probes and the C, D and E junction probes optimally cover the splicing events. B) Probes that can completely cover a single exon skip are also present with the same configuration. Likewise, exon-exon (X), exon-intron (Z) and intron-exon (Y) junction probes are also present.

Figure 2:
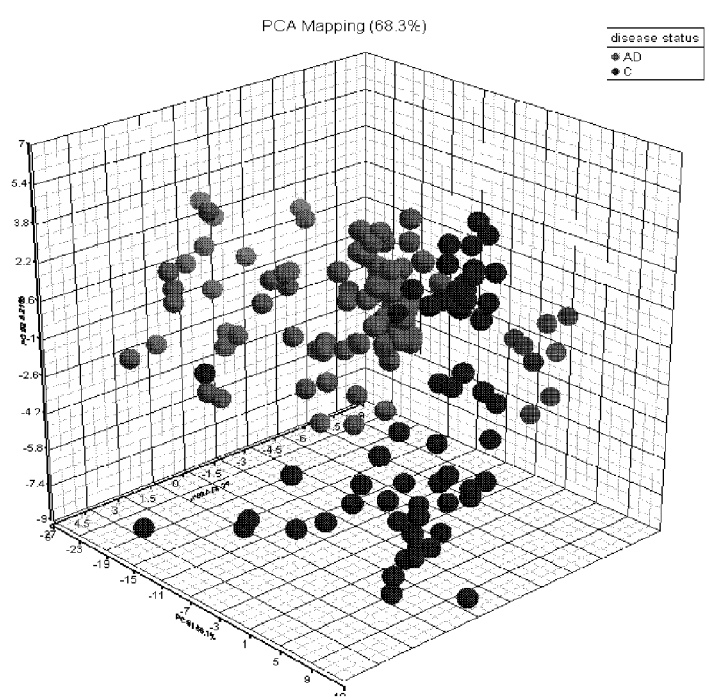

FIG. 2. Principal Component Analysis of AD patients and controls with the SVM signature of panel 50.

Figure 3:
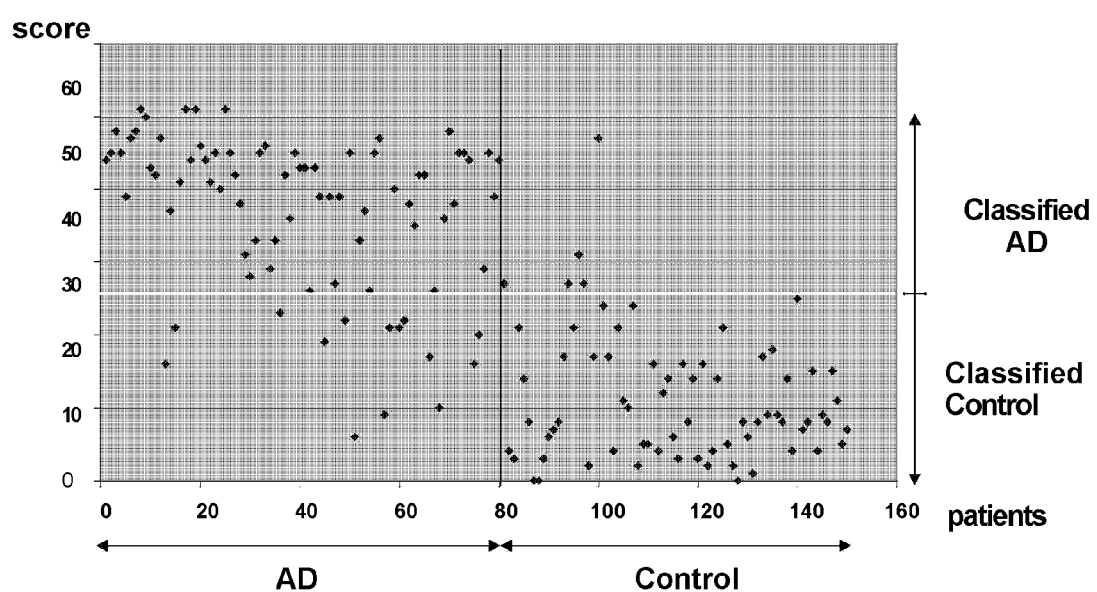

FIG. 3. Classification scores obtained from 51 probe set pairs from PTPRC, SORL1 and PSEN1 genes. AD Patients: No. 1 to 80. Control individuals: No. 81 to 150. The maximal score is 51. The horizontal white line shows the value 25.5. Any patient whose score is above this value is classified as AD. Any patient whose score is below this value is classified as control.

Figure 4:
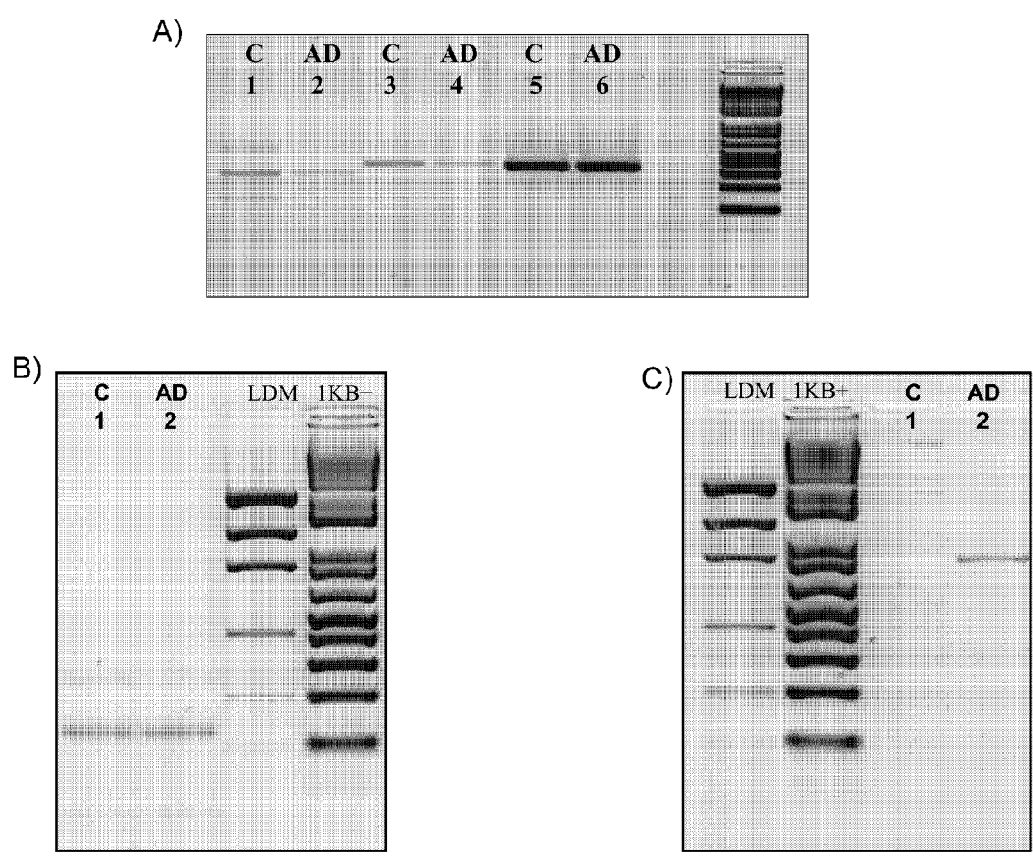

FIG. 4. RT-PCR tests. A) PTPRC gene. 1-2: Primers in exon 2 and intron 5; 3-4: Primers in exon 4 and intron 5; 5-6: Tubulin primers (positive control). B) SORL1 gene. 1-2: Primers in intron 41 and exon 42. C) PSEN1 gene. 1-2: Primers in alternative exon represented by EST AK122722.1, located between exons 3 and 4 and in exon 4.

Figure 5:
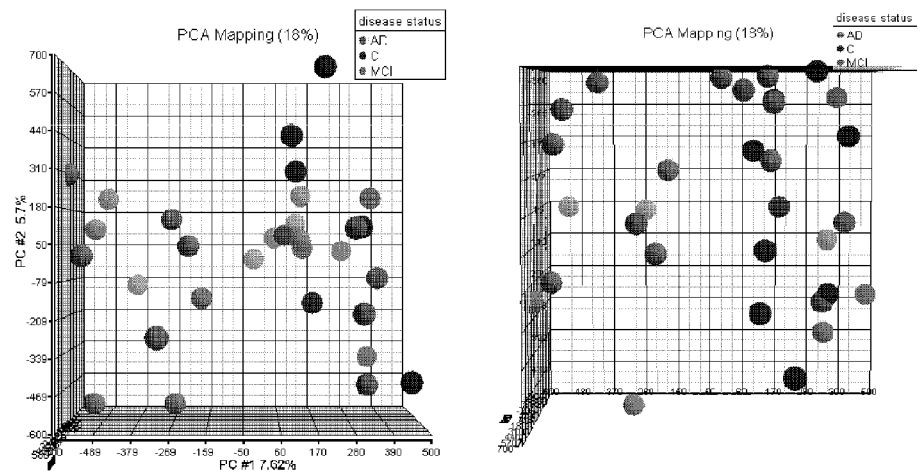
Figure 5:
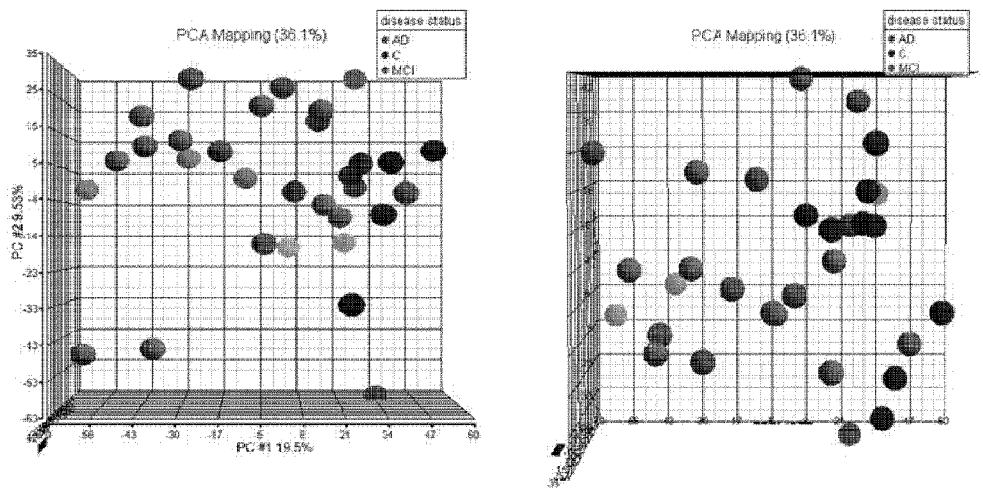

FIG. 5. Principal Component Analysis of AD, MCI and C patients from all the groups of probes present on the GWSA array (FIG. 5A) or a sub-selection made up of 5562 groups of probes among the 5578 (FIG. 5B).

Figure 6:
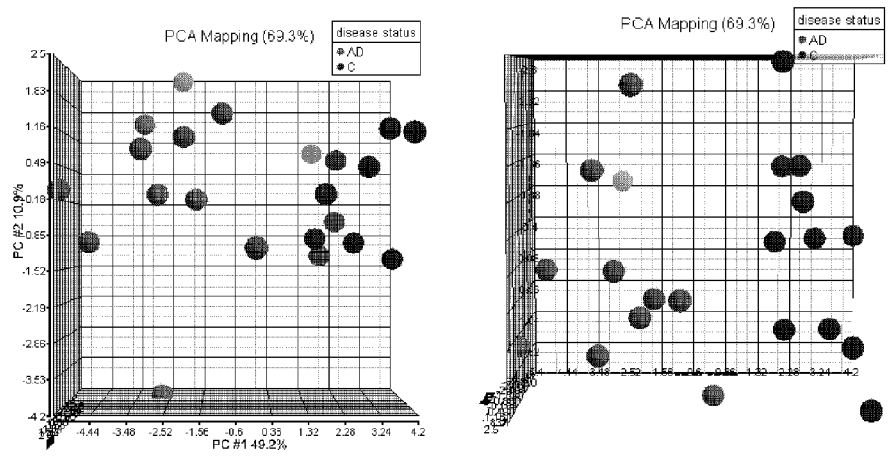
Figure 6:
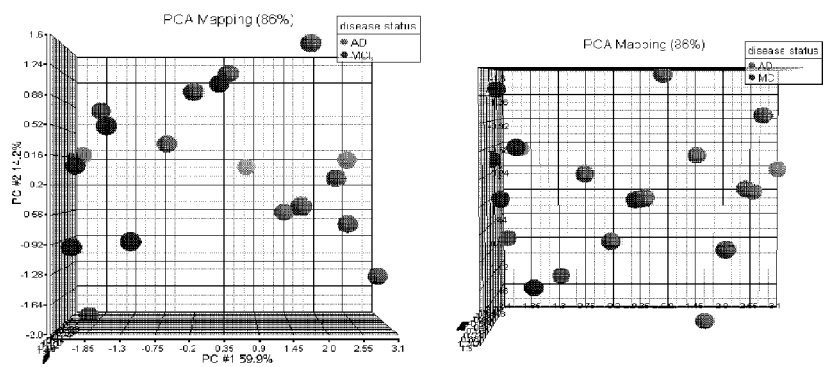
Figure 6:
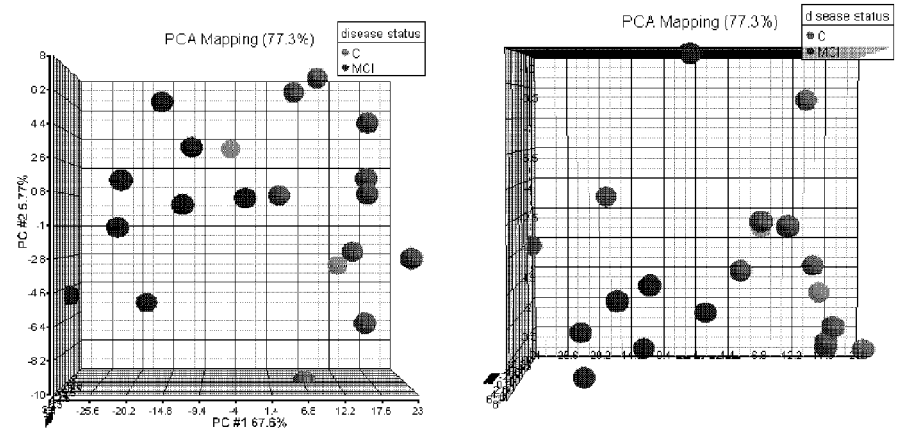

FIG. 6. Visualization of the patient distribution by Principal Component Analysis of MCI, AD or C patients from specifically selected sub-sets of groups of probes (robe sets, PS). FIG. 6A, discrimination between AD and C patients from a set of 18 probes; FIG. 6B, discrimination between MCI and AD patients from a set of 6 probes; FIG. 6C, discrimination between AD and C patients from a set of 373 probes.

TABLE LEGEND

Table 1. Table associated with 5578 target sequences (SEQ ID NO: 1-5578) and the different panels or subgroups. Column A: GWSA references for the target sequences. Column B: SEQ ID NO. Column C: Gene ID Number (Genbank). Columns D to F: Target sequences present (1) in pairs of groups TSP 1300 SS, TSP NN and TSP N. Columns G to BD. Panels 1 to 50. Columns BE to BG. Better target sequences from ANOVA analyses. Column BH. Targets associated with new isoforms of RT-PRC, SORL1 and PSEN1. Columns B1 to BN: Panels 55 to 60.

Table 2. Table associated with the best pairs of probe sets. Column A: GWSA references for the pairs. Column B: GWSA references for the first probe set in each pair. Column C: GWSA references of the second probe set in each pair. Column D: SEQ ID NO of the first probe set. Column E: SEQ ID NO of the second probe set. Column F: SEQ ID NO of both probe sets present in the pair (separated by "_" Column G: Score of TSP 1300 SS pairs. Column H: Score of TSP NN pairs. Column I: Score of TSP N pairs.

EXAMPLE 1

Identification of Serum Markers for Alzheimer's Disease 1.1. Characteristics of the Biological Samples The examples presented below were initially made from 150 blood samples (5 mL of whole blood, taken in two Pax-Gene tubes). These samples accounted for 80 patients diagnosed with Alzheimer's disease according to the DSM IV criteria. These patients corresponded to a mean age of 72.9 years (standard deviation: 5.5 years). These patients had a MMSE (Mini-Mental State Examination) below 20 (means score 13.7; standard deviation 6.7) and a GDS (Global Deterioration Scale) greater than or equal to 4. Furthermore, 70 subjects of comparable age to the AD patients, declared free of dementia after a clinical examination were also recruited (mean age 68.2 years with a standard deviation of 6.3 years; mean MMSE of 29.8 with a standard deviation of 0.4).

1.2. Extraction of Total RNA from the Blood Sample

The blood samples were collected directly in PAXGene™ Blood RNA tubes (PreAnalytix, Hombrechtikon, Switzerland). After the step of taking the blood and in order to obtain total cell lysis, the tubes were left at ambient temperature for 4 h and then kept at −20° C. until extraction of the biological material More precisely, in this protocol, the total RNA were extracted by means of PAXGene Blood RNA® kits (PreAnalytix) in accordance with the manufacturer's recommendations. Briefly, the tubes were centrifuged (15 min, 3000 g) in order to obtain a nucleic acid pellet. This pellet was washed and held in a buffer containing the proteinase K necessary for digesting the proteins (10 min at 55° C.). A new centrifugation (5 min, 19,000 g) was done to eliminate the cellular debris and ethanol was added in order to optimize the conditions for nucleic acid bonding. The total RNA were specifically bound on PAXgene RNA spin columns and, before their elution, the contaminant DNA were digested by means of an RNAse free DNAse set (Qiagen, Hilden, Germany). The quality and quantity of the total RNA extracted were evaluated by electrophoretograms by means of a Bioanalyser 2100 from Agilent by using the 600 NanoChip RNA kit (Agilent Technologies, Santa Clara, Calif.). Only the samples fulfilling the quality criteria were used for the final analyses.

1.3. The GWSA (Genome Wide SpliceArray) Microarray

The detection and quantification of the exhaustive expression of transcripts by microarray requires the use of a particular probe configuration. Every reference messenger RNA/splice variant pair can be modeled as long isoform/short isoform (FIG. 1A). Thus, a splice variant associated with an exon skip will be the short isoform with regard to the reference variant. A splice variant containing a new exon or retaining an intron will be the long isoform with regard to the reference variant. The other alternative splicing events (use of cryptic 5' or 3' splice sites) can also be modeled in the same way.

The probe set necessary for measuring the expression of splice variants is also indicated in FIG. 1A. This set is made up of three traditional "exon" probes F, T and B and three exon-exon or exon-intron junction probes C, D and E. Probes F and T measure the expression of both isoforms, probes B, C and D the expression of the long isoform and probe E the expression of the short isoform.

In order to design all these probes, it is necessary to identify the splicing events corresponding to human genes, then the "target" regions from which the probes will be designed. The target sequences corresponding to junction probes C, D and E are defined by a length of 30 nucleotides, 15 nucleotides from either side of the junction. It is thus possible to cover any junction by 25 nucleotide probes, for example: 11/14, 12/13, 13/12 (the/sign representing the junction zone).

The GWSA chip is a microarray that can provide very complete coverage of human genome expression by taking into account the existence of splice variants. 20,649 human genes were selected then analyzed to identify the associated known and potential splicing events. More than 90% of these genes could be associated with such events. Probes such as described above have been designed from a few of the 140,000 identified splicing events. Furthermore, the use of probes specific for splicing events corresponding to single exon skips also allows predicting the existence of such events (FIG. 1B). Moreover, the incorporation of junction probes covering each exon-exon, exon-intron and intron-exon region of each gene also allows characterizing the splicing events affecting the 5' and 3' ends of the exons (FIG. 1B). Three different probes have been designed per target sequence and combined in a "Probe Set". The expression values of the individual probes are consolidated into a Probe Set value. Sometimes, the Probe Set only contains 2 or even 1 probe if the target sequence restrictions are too constraining. The GWSA is a microarray built on the GeneChip® d'Affymetrix platform with a resolution of 5 microns. The GWSA underwent a quality control according to MAQC standards (Microarray Quality Control; Shi et al., Nat Biotechnol. 2006; 24(9): 1151-61).

1.4. RNA Amplification

Fifty ng of total RNA served as a matrix for the synthesis of targets by means of the WTOvation™ Pico RNA Amplification System kit (NuGen, San Carlos, Calif.). The FL-Ovation™ cDNA Biotin Module (NuGen, San Carlos, Calif.) was then used for the fragmentation of 5 μg of amplified cDNA as well as for the biotin labeling. The various steps were conducted by following the manufacturer's instructions. Each amplification/fragmentation/labeling series contained as many samples from AD patients as controls.

The quality and quantity of the total complementary DNA extracted were evaluated by electropherogram by means of a Bioanalyser 2100 from Agilent by using the 600 NanoChip RNA kit (Agilent Technologies, Santa Clara, Calif.).

1.5. Hybridization on the GWSA Array

Five μg of amplified and biotin-labeled cDNA are used per hybridization. The standard methods recommended by Affymetrix (Affymetrix, Santa Clara, Calif.) were applied for hybridization of the targets on the GWSA microarray. The DNA chips were then washed and the specific hybridization was visualized by following Affymetrix' recommendations. The hybridization signals were detected by means of a GeneChipR3000 7G scanner.

1.6. Data Extraction and Normalization

.CEL files obtained after scanning the slides were then imported into Partek Genomic Suites™ (Partek Incorporated, St Louis, Mich.) for quantile normalization of the arrays, background noise adjustment as a function of the GC composition of the oligonucleotide probes, background noise correction by RMA and consolidation of the expression values measured for each oligonucleotide in the probe set.

The data were then filtered with regard to the expression values of the probe sets; the expression level threshold was set at 3.8 (log 2 scale) based on the distribution frequency of the expression values on all the arrays.

1.7. Data Analysis for Signature Selection and Probe Normalization 1.7.1 Selection of signatures from the absolute expression of the probes.

A first group of 100 individuals (53 AD and 47 controls) was created among the 150 patients of the cohort for learning signature discriminant(s) by supervised clustering analyses using binary classification algorithms such as Support Vector Machine (SVM), K-Nearest Neighbor (KNN) and Linear Discriminant Analysis (LDA) and cross validation with partitions of 10 (Partek Genomic Suites™). Non-parametric tests (1-way and 2-way ANOVA) were conducted to analyze the expression values obtained per probe set and serve as a filtering tool for selecting the variables that will integrate the signature. A first signature of 170 markers was then characterized and evaluated in a group of independent test patients (see 8.1). Subsequently, 4 other learning groups were created to average a possible effect of the specific choice of a first learning group. Thus, 5 groups of 100 patients (53 AD and 47 controls) was created among the 150 patients of the cohort for learning signature discriminant(s) by supervised clustering analysis using binary classification algorithms such as Support Vector Machine (SVM), K-Nearest Neighbor (KNN) and Linear Discriminant Analysis (LDA) and cross validation with scores of 10 (Partek Genomic Suites™). Non-parametric tests (1-way and 2-way ANOVA) were conducted to analyze the expression values obtained per probe set and serve as a filtering tool for selecting the variables that will integrate the signature. The optimal classification model per learning group is then applied to the corresponding test group made up of 50 patients (27 AD and 23 controls) to identify the performances of the signature, i.e., specificity (% of correct classification of control patients) and sensitivity (% of correct classification of AD patients).

3770 models were tested in each learning group; the performances of each model were evaluated on all the learning groups. The models were then classified with regard to the mean of the performances over the 5 groups. The signatures presenting the highest performance means were selected to discriminate between patients with Alzheimer's disease and control patients without dementia.

1.7.2 Selection of Signatures from the Relative Expression of Probes Pairs.

This type of analysis, called TSP, consists of selecting probe sets in pairs whose relative expression is reversed between the two groups that are compared, AD and control (Geman et al., 2004 Stat Appl Genet Mol Biol 3: Article 19). The use of k pairs of probe sets is a variant called k-TSP (Tan et al., 2005 Bioinformatics 21: 3896-3904). For each gene, a list of all the probe set pairs is created. The expression levels of each probe set in a pair are compared per sample/microarray. The probability for the first probe set to have an expression level greater than the second is calculated for each of the AD and control groups. The difference of these two probabilities defines a score. The Top-Scoring Pair (TSP) or the k-Top Scoring-Pairs correspond to the best or to the k-best scores. A permutation analysis is then done 1000 times by defining two groups randomly from the same 150 individuals. The maximum score obtained by a pair among these 1000 permutations can then be compared to the best scores obtained from real AD and control pairs, making it possible to judge the statistical relevance of such scores.

1.7.3 Selection of the Normalization Probes

The normalization probe sets fulfill the following conditions:
  there is no statistically significant difference between AD and controls
  their variance is low before and after normalization
  the distribution of their intensities is comparable to the entire array after normalization The probe sets statistically significant for a difference between AD patients and control patients with a False Discovery Rate of 0.01 were eliminated from the normalized and non-normalized files containing the probe set expression values corresponding to the 150 patients filtered with a threshold value of 3.8 (log 2).

The variance was then calculated for each probe set from normalized and non-normalized files. The probe sets common to both files and having the lowest variance values were chosen.

These probe sets were classified by intensity according to the distribution of intensities measured on the normalized and filtered file. Probe sets were then selected in each intensity class with regard to decreasing p-values from the ANOVA statistical test.

EXAMPLE 2

Identification of Expression Profiles for Diagnosing Alzheimer's Disease from Blood Samples 2.1. Identification of an Expression Profile for Discriminating Control Patients with No Dementia (CND) from Patients with Alzheimer's Disease (AD).

The expression of the entire human transcriptome, representing approximately 21,000 genes, has been analyzed and compared between AD and CND patients by means of the GWSA microarray. All the analyses discussed in sections 7.1 and 7.2 has allowed identifying a collection of 5578 target sequences, pertinent according to the invention (see Table 1, SEQ ID Nos: 1-5578).

These sequences are partially composed of three groups of probe sets coming from ANOVA analyses of one or two parameters (1-way or 2-way).

More precisely, it is group or panel 51 (Table 1) represented by SEQ ID NO: 16; 18; 19; 21; 22; 38; 39; 40; 41; 42; 43; 44; 45; 46; 47; 48; 62; 67; 73; 79; 80; 83; 84; 86; 88; 89; 94; 108; 109; 110; 113; 119; 125; 126; 127; 128; 143; 150; 156; 157; 164; 165; 175; 178; 179; 180; 182; 187; 190; 191; 213; 260; 261; 262; 263; 271; 272; 275; 281; 284; 294; 295; 308; 310; 311; 312; 313; 314; 321; 322; 323; 327; 337; 341; 343; 347; 348; 350; 351; 353; 355; 356; 357; 362; 366; 370; 372; 376; 377; 378; 379; 388; 394; 396; 399; 400; 402; 404; 405; 406; 408; 409; 410; 413; 416; 421; 423; 425; 426; 441; 442; 443; 444; 445; 446; 448; 449; 450; 451; 452; 453; 454; 455; 456; 457; 458; 462; 465; 466; 467; 468; 469; 470; 471; 472; 473; 474; 475; 501; 502; 503; 513; 514; 515; 519; 520; 523; 524; 528; 532; 533; 535; 537; 540; 541; 543; 547; 556; 565; 566; 567; 568; 572; 581; 582; 583; 590; 592; 595; 600; 602; 603; 606; 607; 608; 609; 613; 618; 620; 634; 635; 636; 637; 641; 646; 647; 654; 655; 656; 657; 659; 660; 663; 667; 669; 676; 684; 686; 687; 688; 695; 696; 704; 705; 706; 707; 709; 710; 713; 720; 731; 732; 737; 739; 742; 754; 760; 769; 775; 776; 778; 782; 783; 784; 785; 786; 787; 790; 796; 808; 809; 810; 811; 826; 833; 836; 839; 852; 857; 867; 868; 891; 912; 913; 914; 915; 916; 922; 923; 924; 925; 927; 928; 930; 931; 932; 933; 934; 935; 936; 940; 948; 950; 951; 952; 956; 957; 976; 977; 978; 979; 980; 982; 983; 984; 985; 986; 988; 1014; 1015; 1016; 1017; 1019; 1020; 1029; 1030; 1031; 1037; 1040; 1041; 1042; 1046; 1049; 1075; 1076; 1077; 1078; 1079; 1080; 1095; 1096; 1100; 1101; 1106; 1108; 1109; 1110; 1112; 1113; 1114; 1115; 1116; 1121; 1140; 1145; 1148; 1149; 1152; 1154; 1156; 1158; 1163; 1164; 1165; 1167; 1169; 1171; 1172; 1173; 1175; 1178; 1179; 1186; 1187; 1191; 1207; 1215; 1230; 1239; 1241; 1260; 1277; 1278; 1286; 1294; 1304; 1309; 1332; 1333; 1354; 1355; 1356; 1357; 1358; 1359; 1361; 1366; 1395; 1396; 1408; 1415; 1416; 1420; 1422; 1428; 1439; 1445; 1472; 1473; 1474; 1484; 1487; 1489; 1490; 1493; 1498; 1509; 1510; 1512; 1513; 1515; 1516; 1517; 1518; 1520; 1521; 1525; 1526; 1527; 1528; 1529; 1530; 1532; 1533; 1535; 1560; 1562; 1563; 1566; 1575; 1576; 1577; 1578; 1579; 1580; 1581; 1582; 1583; 1584; 1589; 1597; 1598; 1599; 1600; 1619; 1621; 1623; 1627; 1634; 1635; 1639; 1640; 1649; 1651; 1652; 1653; 1669; 1670; 1671; 1672; 1673; 1675; 1680; 1689; 1694; 1696; 1697; 1709; 1710; 1713; 1717; 1721; 1722; 1725; 1729; 1732; 1734; 1741; 1742; 1743; 1744; 1747; 1748; 1749; 1753; 1756; 1762; 1763; 1764; 1765; 1770; 1771; 1772; 1773; 1774; 1775; 1776; 1779; 1780; 1781; 1785; 1787; 1788; 1790; 1791; 1792; 1793; 1794; 1800; 1801; 1802; 1805; 1824; 1825; 1826; 1827; 1828; 1829; 1830; 1831; 1833; 1834; 1837; 1839; 1840; 1844; 1845; 1847; 1851; 1855; 1856; 1857; 1858; 1861; 1862; 1910; 1913; 1914; 1915; 1916; 1917; 1918; 1919; 1935; 1938; 1942; 1946; 1947; 1948; 1950; 1952; 1953; 1956; 1961; 1966; 1969; 1971; 1972; 1976; 1977; 1978; 1983; 1984; 1995; 1996; 1999; 2000; 2002; 2012; 2020; 2021; 2025; 2041; 2045; 2047; 2050; 2051; 2060; 2063; 2064; 2087; 2088; 2090; 2093; 2097; 2098; 2099; 2102; 2109; 2113; 2127; 2128; 2129; 2130; 2132; 2135; 2136; 2143; 2144; 2159; 2160; 2161; 2164; 2166; 2177; 2178; 2182; 2204; 2214; 2215; 2216; 2217; 2235; 2241; 2242; 2243; 2267; 2268; 2270; 2271; 2272; 2278; 2279; 2283; 2305; 2306; 2311; 2312; 2313; 2314; 2315; 2316; 2317; 2318; 2319; 2321; 2322; 2323; 2324; 2325; 2326; 2327; 2328; 2331; 2332; 2336; 2341; 2343; 2344; 2346; 2347; 2348; 2361; 2362; 2368; 2371; 2372; 2373; 2375; 2376; 2377; 2379; 2380; 2381; 2382; 2383; 2384; 2389; 2391; 2392; 2395; 2396; 2397; 2399; 2405; 2406; 2407; 2408; 2409; 2410; 2411; 2412; 2413; 2414; 2415; 2417; 2418; 2441; 2443; 2444; 2445; 2446; 2447; 2451; 2456; 2458; 2460; 2465; 2469; 2472; 2486; 2493; 2494; 2520; 2521; 2524; 2526; 2527; 2528; 2529; 2530; 2531; 2532; 2533; 2534; 2536; 2538; 2539; 2543; 2556; 2563; 2577; 2578; 2579; 2582; 2583; 2584; 2586; 2587; 2588; 2589; 2590; 2591; 2592; 2600; 2601; 2603; 2606; 2612; 2613; 2616; 2617; 2618; 2636; 2648; 2658; 2660; 2676; 2679; 2680; 2684; 2691; 2692; 2694; 2695; 2696; 2697; 2698; 2699; 2700; 2701; 2702; 2703; 2725; 2727; 2728; 2740; 2741; 2742; 2743; 2762; 2763; 2765; 2770; 2771; 2772; 2773; 2775; 2776; 2783; 2791; 2793; 2795; 2796; 2800; 2803; 2804; 2809; 2810; 2828; 2843; 2844; 2850; 2851; 2852; 2853; 2860; 2862; 2863; 2865; 2867; 2871; 2872; 2874; 2879; 2886; 2890; 2892; 2893; 2894; 2895; 2897; 2898; 2899; 2902; 2904; 2905; 2906; 2907; 2909; 2910; 2914; 2915; 2916; 2917; 2919; 2920; 2922; 2924; 2925; 2930; 2933; 2934; 2935; 2936; 2937; 2938; 2939; 2940; 2941; 2943; 2944; 2945; 2946; 2947; 2950; 2951; 2953; 2954; 2983; 2991; 2997; 3018; 3028; 3035; 3036; 3037; 3041; 3042; 3043; 3055; 3056; 3057; 3061; 3065; 3073; 3074; 3075; 3076; 3085; 3086; 3089; 3102; 3105; 3108; 3109; 3110; 3111; 3118; 3150; 3161; 3164; 3165; 3166; 3167; 3175; 3188; 3191; 3194; 3195; 3196; 3205; 3207; 3215; 3219; 3221; 3223; 3224; 3225; 3226; 3233; 3234; 3235; 3252; 3260; 3270; 3273; 3277; 3280; 3285; 3286; 3297; 3298; 3301; 3302; 3303; 3307; 3308; 3310; 3311; 3312; 3314; 3315; 3322; 3323; 3324; 3326; 3330; 3335; 3341; 3344; 3345; 3346; 3349; 3350; 3358; 3360; 3361; 3362; 3366; 3373; 3377; 3378; 3379; 3380; 3384; 3406; 3409; 3410; 3411; 3412; 3413; 3420; 3421; 3427; 3428; 3434; 3442; 3443; 3452; 3461; 3474; 3480; 3483; 3487; 3489; 3490; 3491; 3495; 3500; 3505; 3507; 3509; 3517; 3521; 3523; 3524; 3532; 3534; 3536; 3539; 3541; 3542; 3553; 3558; 3559; 3562; 3563; 3564; 3572; 3574; 3576; 3577; 3578; 3579; 3581; 3582; 3583; 3586; 3587; 3588; 3595; 3596; 3597; 3598; 3599; 3600; 3601; 3602; 3607; 3608; 3609; 3610; 3615; 3627; 3628; 3629; 3632; 3639; 3646; 3649; 3650; 3657; 3671; 3673; 3696; 3705; 3707; 3708; 3709; 3732; 3733; 3743; 3748; 3751; 3752; 3753; 3758; 3761; 3762; 3772; 3773; 3775; 3776; 3777; 3778; 3783; 3789; 3790; 3793; 3796; 3799; 3806; 3808; 3819; 3820; 3849; 3853; 3855; 3856; 3857; 3859; 3862; 3863; 3864; 3871; 3884; 3889; 3890; 3912; 3913; 3915; 3919; 3920; 3921; 3929; 3931; 3932; 3934; 3937; 3938; 3939; 3940; 3943; 3944; 3950; 3951; 3952; 3953; 3955; 3956; 3958; 3961; 3962; 3963; 3964; 3965; 3969; 3973; 3974; 3977; 3990; 3991; 3992; 3995; 4001; 4004; 4005; 4006; 4009; 4010; 4011; 4012; 4014; 4015; 4051; 4053; 4054; 4063; 4064; 4070; 4078; 4091; 4092; 4093; 4095; 4096; 4097; 4111; 4115; 4119; 4121; 4154; 4158; 4170; 4171; 4175; 4193; 4198; 4200; 4201; 4202; 4206; 4207; 4208; 4209; 4219; 4221; 4222; 4227; 4228; 4229; 4230; 4232; 4234; 4255; 4260; 4266; 4280; 4282; 4292; 4293; 4296; 4297; 4298; 4299; 4300; 4306; 4307; 4308; 4309; 4312; 4316; 4327; 4330; 4331; 4336; 4337; 4340; 4341; 4342; 4343; 4344; 4345; 4346; 4347; 4348; 4349; 4350; 4351; 4352; 4357; 4358; 4364; 4365; 4378; 4379; 4380; 4386; 4398; 4399; 4400; 4426; 4430; 4431; 4432; 4435; 4438;

4469; 4472; 4475; 4476; 4482; 4488; 4492; 4499; 4505; 4506; 4532; 4547; 4548; 4549; 4550; 4551; 4554; 4555; 4556; 4558; 4559; 4582; 4592; 4593; 4594; 4595; 4603; 4607; 4609; 4611; 4612; 4613; 4617; 4618; 4619; 4621; 4623; 4624; 4629; 4656; 4661; 4662; 4663; 4666; 4671; 4672; 4674; 4675; 4676; 4677; 4678; 4679; 4684; 4693; 4694; 4695; 4698; 4710; 4713; 4718; 4732; 4733; 4734; 4735; 4738; 4744; 4749; 4765; 4768; 4769; 4771; 4779; 4780; 4781; 4782; 4783; 4789; 4790; 4798; 4799; 4805; 4808; 4809; 4810; 4812; 4813; 4816; 4823; 4824; 4826; 4827; 4828; 4831; 4833; 4851; 4856; 4859; 4860; 4861; 4862; 4865; 4867; 4868; 4869; 4873; 4874; 4876; 4883; 4884; 4896; 4905; 4908; 4909; 4910; 4917; 4920; 4921; 4922; 4923; 4924; 4926; 4927; 4928; 4929; 4932; 4933; 4934; 4935; 4938; 4943; 4944; 4946; 4948; 4949; 4951; 4952; 4953; 4954; 4955; 4957; 4958; 4960; 4962; 4964; 4966; 4967; 4970; 4973; 4980; 4985; 4987; 4998; 5000; 5001; 5004; 5011; 5012; 5015; 5016; 5017; 5018; 5020; 5022; 5024; 5025; 5026; 5029; 5030; 5031; 5037; 5038; 5039; 5041; 5042; 5043; 5044; 5045; 5046; 5047; 5048; 5052; 5053; 5055; 5057; 5058; 5061; 5067; 5069; 5080; 5084; 5096; 5098; 5099; 5100; 5101; 5104; 5109; 5111; 5112; 5116; 5122; 5133; 5134; 5135; 5136; 5137; 5138; 5139; 5140; 5144; 5145; 5146; 5154; 5155; 5157; 5158; 5159; 5160; 5163; 5165; 5166; 5167; 5174; 5175; 5180; 5182; 5186; 5188; 5190; 5191; 5195; 5196; 5197; 5198; 5199; 5200; 5202; 5203; 5204; 5206; 5209; 5210; 5211; 5212; 5221; 5231; 5238; 5239; 5244; 5245; 5246; 5247; 5254; 5257; 5265; 5269; 5271; 5288; 5290; 5317; 5325; 5329; 5335; 5336; 5337; 5353; 5365; 5370; 5372; 5374; 5376; 5380; 5383; 5384; 5396; 5407; 5408; 5409; 5410; 5411; 5412; 5413; 5414; 5415; 5425; 5428; 5439; 5440; 5441; 5443; 5465; 5466; 5469; 5494; 5495; 5499; 5500; 5518; 5520; 5521; 5522; 5523; 5524; 5525; 5528; 5530; 5531; 5532; 5533; 5534; 5535; 5537; 5538; 5539; 5540; 5553; 5555; 5564; 5569; 5575; 5576; 5577

All these probe sets have a p-value (AD vs. control) less than $3.19\ e^{-08}$

It is also the second or group or panel 52 represented by SEQ ID NO: 1; 6; 8; 28; 59; 60; 61; 83; 90; 91; 121; 133; 181; 182; 224; 311; 314; 321; 323; 331; 339; 340; 342; 343; 354; 356; 397; 417; 418; 420; 429; 446; 449; 453; 455; 473; 522; 538; 596; 598; 600; 601; 604; 611; 613; 636; 638; 661; 690; 696; 720; 724; 738; 742; 762; 788; 845; 852; 926; 939; 990; 1050; 1146; 1150; 1151; 1152; 1153; 1154; 1160; 1185; 1203; 1206; 1214; 1215; 1237; 1239; 1242; 1322; 1326; 1357; 1394; 1397; 1398; 1413; 1414; 1422; 1489; 1490; 1501; 1511; 1531; 1539; 1552; 1559; 1588; 1592; 1609; 1637; 1641; 1650; 1658; 1671; 1675; 1683; 1692; 1694; 1695; 1699; 1702; 1711; 1723; 1729; 1730; 1731; 1740; 1741; 1742; 1743; 1744; 1747; 1749; 1756; 1789; 1800; 1806; 1831; 1832; 1833; 1834; 1836; 1837; 1850; 1853; 1859; 1939; 1951; 1964; 1972; 1985; 1994; 1995; 1999; 2022; 2023; 2024; 2038; 2060; 2061; 2062; 2068; 2073; 2078; 2081; 2086; 2090; 2091; 2111; 2116; 2117; 2118; 2119; 2120; 2121; 2122; 2123; 2124; 2125; 2126; 2127; 2128; 2129; 2130; 2132; 2133; 2143; 2144; 2146; 2147; 2148; 2169; 2187; 2190; 2191; 2192; 2195; 2196; 2209; 2284; 2351; 2352; 2353; 2358; 2360; 2365; 2366; 2367; 2369; 2370; 2371; 2372; 2374; 2375; 2378; 2380; 2382; 2394; 2399; 2402; 2411; 2412; 2435; 2454; 2458; 2459; 2461; 2462; 2465; 2469; 2472; 2488; 2489; 2490; 2518; 2528; 2529; 2532; 2533; 2534; 2536; 2538; 2542; 2543; 2544; 2545; 2546; 2548; 2556; 2557; 2558; 2559; 2561; 2563; 2564; 2575; 2585; 2590; 2642; 2649; 2652; 2659; 2679; 2684; 2692; 2695; 2703; 2708; 2709; 2710; 2714; 2724; 2725; 2727; 2729; 2732; 2740; 2745; 2790; 2811; 2813; 2865; 2887; 2888; 2900; 2902; 2908; 2921; 2928; 2941; 2942; 2943; 2944; 2975; 2976; 2983; 3001; 3014; 3018; 3023; 3043; 3045; 3057; 3092; 3104; 3171; 3172; 3173; 3192; 3206; 3211; 3216; 3221; 3243; 3271; 3286; 3301; 3304; 3312; 3325; 3333; 3356; 3365; 3384; 3387; 3388; 3389; 3427; 3429; 3483; 3487; 3491; 3500; 3520; 3526; 3533; 3554; 3559; 3574; 3580; 3600; 3673; 3685; 3686; 3688; 3690; 3692; 3706; 3741; 3751; 3763; 3782; 3805; 3806; 3807; 3808; 3809; 3810; 3811; 3812; 3813; 3819; 3820; 3821; 3822; 3823; 3857; 3859; 3862; 3867; 3904; 3906; 3909; 3920; 3930; 3936; 3940; 3950; 3958; 3961; 3985; 4012; 4013; 4015; 4019; 4076; 4091; 4093; 4094; 4096; 4124; 4130; 4200; 4265; 4295; 4297; 4343; 4345; 4350; 4351; 4352; 4398; 4428; 4434; 4442; 4468; 4471; 4476; 4478; 4479; 4493; 4494; 4497; 4498; 4501; 4510; 4515; 4525; 4546; 4583; 4584; 4591; 4592; 4598; 4603; 4659; 4676; 4706; 4710; 4733; 4737; 4744; 4780; 4793; 4797; 4799; 4804; 4806; 4807; 4860; 4879; 4885; 4887; 4888; 4889; 4890; 4891; 4892; 4895; 4896; 4897; 4898; 4899; 4905; 4907; 4918; 4944; 4955; 4968; 4969; 4975; 4976; 4977; 4978; 4979; 4982; 4999; 5000; 5028; 5031; 5059; 5080; 5125; 5144; 5156; 5170; 5188; 5195; 5196; 5198; 5206; 5221; 5237; 5238; 5245; 5246; 5247; 5249; 5254; 5257; 5285; 5289; 5305; 5320; 5333; 5363; 5371; 5379; 5380; 5383; 5398; 5416; 5421; 5450; 5498; 5501; 5529; 5534; 5535; 5538; 5555; 5562

All these probe sets have a p-value (AD vs. control) less than $1.17\ e^{-12}$

It is also a third or group or panel 53 represented by SEQ ID NO: 15; 17; 20; 25; 26; 50; 51; 52; 58; 66; 75; 87; 98; 99; 101; 103; 105; 114; 115; 116; 117; 118; 120; 166; 167; 171; 173; 216; 278; 285; 300; 325; 338; 354; 365; 371; 397; 398; 403; 407; 424; 459; 473; 476; 482; 506; 509; 510; 511; 516; 517; 518; 521; 527; 536; 539; 569; 570; 571; 591; 593; 597; 598; 599; 614; 617; 619; 629; 661; 664; 666; 668; 677; 689; 690; 692; 693; 694; 711; 721; 722; 726; 751; 768; 777; 788; 789; 791; 842; 869; 872; 893; 894; 895; 896; 905; 921; 1032; 1033; 1043; 1044; 1045; 1070; 1147; 1155; 1157; 1159; 1161; 1162; 1168; 1170; 1174; 1185; 1218; 1220; 1225; 1226; 1229; 1237; 1238; 1239; 1240; 1242; 1253; 1254; 1258; 1259; 1268; 1270; 1346; 1348; 1349; 1362; 1364; 1365; 1401; 1417; 1421; 1432; 1440; 1491; 1494; 1495; 1496; 1522; 1524; 1561; 1588; 1616; 1617; 1618; 1622; 1630; 1632; 1654; 1667; 1668; 1674; 1691; 1692; 1700; 1701; 1718; 1744; 1767; 1784; 1786; 1798; 1807; 1808; 1809; 1810; 1811; 1812; 1813; 1814; 1815; 1816; 1834; 1838; 1841; 1843; 1853; 1859; 1912; 1920; 1951; 1986; 2001; 2008; 2009; 2010; 2011; 2023; 2042; 2085; 2096; 2106; 2107; 2108; 2110; 2111; 2112; 2114; 2115; 2128; 2134; 2137; 2139; 2140; 2141; 2143; 2144; 2148; 2158; 2165; 2167; 2168; 2203; 2207; 2218; 2226; 2246; 2247; 2248; 2249; 2250; 2251; 2252; 2253; 2254; 2255; 2256; 2258; 2260; 2261; 2263; 2264; 2265; 2266; 2269; 2280; 2281; 2307; 2310; 2320; 2329; 2340; 2345; 2350; 2393; 2401; 2411; 2421; 2436; 2442; 2450; 2462; 2517; 2543; 2555; 2560; 2594; 2599; 2602; 2619; 2620; 2621; 2622; 2632; 2633; 2638; 2695; 2714; 2727; 2788; 2789; 2816; 2817; 2818; 2822; 2823; 2824; 2825; 2827; 2831; 2838; 2869; 2870; 2887; 2888; 2889; 2896; 2900; 2903; 2932; 2943; 2979; 2982; 2985; 2994; 3005; 3053; 3066; 3087; 3106; 3107; 3153; 3156; 3157; 3158; 3159; 3160; 3180; 3185; 3186; 3200; 3211; 3217; 3218; 3222; 3266; 3268; 3278; 3279; 3281; 3304; 3305; 3309; 3313; 3317; 3338; 3374; 3375; 3381; 3430; 3462; 3502; 3506; 3508; 3518; 3519; 3520; 3522; 3525; 3527; 3530; 3531; 3535; 3540; 3567; 3573; 3623; 3624; 3625;

3626; 3670; 3672; 3685; 3713; 3734; 3759; 3771; 3782; 3786; 3804; 3814; 3815; 3816; 3824; 3826; 3828; 3829; 3830; 3842; 3843; 3844; 3847; 3848; 3851; 3870; 3872; 3895; 3896; 3897; 3898; 3954; 3960; 3966; 3967; 3968; 3972; 3975; 3976; 3978; 3987; 3993; 4008; 4094; 4096; 4112; 4125; 4164; 4172; 4184; 4185; 4192; 4223; 4233; 4269; 4281; 4359; 4370; 4371; 4375; 4381; 4388; 4398; 4419; 4425; 4427; 4428; 4429; 4433; 4470; 4481; 4483; 4493; 4495; 4502; 4507; 4509; 4553; 4575; 4581; 4610; 4622; 4658; 4660; 4664; 4665; 4688; 4692; 4711; 4712; 4714; 4716; 4722; 4791; 4792; 4857; 4865; 4872; 4959; 4961; 4965; 4974; 4981; 4988; 5019; 5021; 5023; 5027; 5049; 5060; 5065; 5066; 5087; 5107; 5108; 5110; 5119; 5123; 5141; 5164; 5173; 5176; 5181; 5183; 5184; 5185; 5187; 5189; 5198; 5206; 5238; 5241; 5270; 5272; 5273; 5338; 5350; 5391; 5417; 5429; 5434; 5435; 5513; 5529; 5578

All these probe sets have a p-value (AD vs. control) less than $6.70\ e^{-15}$

The inventors then studied the simultaneous expression of probe sets associated with sub-sets of these 5578 sequences to obtain relevant expression profiles for Alzheimer's disease. A randomized learning group of 100 individuals (53 AD and 47 NDC) and an SVM classification algorithm allowed identifying a signature composed of 170 Probe Sets corresponding to panel 50 (Table 1) and to SEQ ID NO:
20; 25; 26; 51; 52; 58; 87; 98; 100; 101; 102; 103; 104; 105; 115; 166; 173; 174; 216; 278; 354; 374; 382; 397; 398; 407; 511; 518; 569; 570; 571; 614; 629; 664; 666; 668; 693; 711; 721; 725; 751; 757; 842; 869; 895; 987; 989; 1033; 1161; 1218; 1229; 1237; 1238; 1240; 1242; 1258; 1259; 1270; 1287; 1346; 1347; 1348; 1362; 1408; 1522; 1590; 1654; 1668; 1694; 1701; 1767; 1786; 1798; 1808; 1809; 1811; 1812; 1813; 1815; 1843; 1859; 1920; 1986; 2008; 2009; 2010; 2011; 2023; 2085; 2110; 2111; 2115; 2218; 2226; 2247; 2256; 2263; 2269; 2281; 2350; 2393; 2411; 2436; 2620; 2788; 2789; 2900; 2943; 2978; 2979; 2993; 2994; 3050; 3103; 3158; 3217; 3266; 3282; 3375; 3508; 3524; 3527; 3531; 3538; 3540; 3552; 3625; 3685; 3713; 3782; 3841; 3898; 3957; 3960; 3966; 3975; 3993; 4007; 4093; 4094; 4096; 4194; 4223; 4370; 4381; 4429; 4433; 4470; 4481; 4483; 4493; 4553; 4560; 4688; 4714; 4716; 4722; 5049; 5107; 5108; 5181; 5183; 5184; 5185; 5198; 5206; 5254; 5391; 5468; 5549

The performances of this signature were evaluated on a TEST collection of individuals who did not participate in defining this signature. This TEST group included 27 AD and 23 NDC. The performances obtained are: a sensitivity of 100% and a specificity of 96%, i.e., 27 AD out of 27 were properly classified as AD by the signature of panel 50 and 22 NDC out of 23 were properly classified as NDC by the signature of panel 50. A principal component analysis allows visualizing the separation of the AD group from the control group (FIG. 2). The 170 markers for this signature correspond to 133 genes. Thirty-one of the 170 probe sets are specifically associated with splice events, mainly new exons and exon skips. RT-PCR experiments confirmed the presence of certain of these transcripts generated by alternative splicing.

The directory of some of the 133 genes provides a precise molecular base, not predictable with certain phenomena described in Alzheimer's disease: activation of macrophages, TGF-beta signaling pathway, oxidative stress, innate immunity, inflammation, cytoskeleton reorganization, involvement of lipid rafts, particularly through cholesterol and sphingolipid signaling pathways, and involvement of the ubiquitin-proteasome system.

2.2. Characterization of Subpanels of Panel 50 and Associated Performances

The inventors also studied the simultaneous expression of sub-sets of 100, 50 and 25 probe sets from the 170 probe sets associated with panel 50.

2.2.1. Characterization of a Panel of 100 Markers (PANEL 49)

The inventors have demonstrated a combination of 100 markers, based on the sequences SEQ ID Nos: 20; 25; 26; 51; 52; 58; 87; 98; 100; 101; 102; 103; 104; 105; 115; 166; 173; 174; 216; 278; 354; 374; 382; 397; 398; 407; 511; 518; 569; 570; 571; 614; 629; 664; 666; 668; 693; 711; 721; 725; 751; 757; 842; 869; 895; 987; 989; 1033; 1161; 1218; 1229; 1237; 1238; 1240; 1242; 1258; 1259; 1270; 1287; 1346; 1347; 1348; 1362; 1408; 1522; 1590; 1654; 1668; 1694; 1701; 1767; 1786; 1798; 1808; 1809; 1811; 1812; 1813; 1815; 1843; 1859; 1920; 1986; 2008; 2009; 2010; 2011; 2023; 2085; 2110; 2111; 2115; 2218; 2226; 2247; 2256; 2263; 2269; 2281; 2350 (see Table 1).

This combination produced a sensitivity of 81% and a specificity of 91% on the TEST group.

2.2.2. Characterization of a Panel of 50 Markers (PANEL 48)

The inventors have demonstrated a combination of 50 markers, based on the sequences SEQ ID Nos: 20; 25; 26; 51; 52; 58; 87; 98; 100; 101; 102; 103; 104; 105; 115; 166; 173; 174; 216; 278; 354; 374; 382; 397; 398; 407; 511; 518; 569; 570; 571; 614; 629; 664; 666; 668; 693; 711; 721; 725; 751; 757; 842; 869; 895; 987; 989; 1033; 1161; 1218 (see Table 1).

This combination produced a sensitivity of 70% and a specificity of 87% on the TEST group.

2.2.3. Characterization of a Panel of 25 Markers (PANEL 47)

The inventors have demonstrated a combination of 25 markers, based on the sequences SEQ ID Nos: 20; 25; 26; 51; 52; 58; 87; 98; 100; 101; 102; 103; 104; 105; 115; 166; 173; 174; 216; 278; 354; 374; 382; 397; 398 (see Table 1).

This combination produced a sensitivity of 89% and a specificity of 61% on the TEST group.

These elements indicate that these sub-signatures retain a diagnostic power that is nevertheless inferior to the parent signature of 170 markers of panel 50.

The inventors then characterized different marker panels from 5 different learning/test groups that will now be described in sections 8.3 to 8.54.

2.3. Identification of a Predictive Panel of 160 Markers (PANEL 1)

The inventors have demonstrated a combination of 160 markers, linked to a KNN algorithm, based on the sequences SEQ ID Nos: 1; 28; 73; 321; 323; 350; 397; 417; 418; 612; 720; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1800; 1831; 1833; 1834; 1837; 1951; 1952; 1953; 1984; 1995; 2023; 2038; 2117; 2126; 2127; 2128; 2129; 2130; 2133; 2144; 2284; 2305; 2365; 2372; 2378; 2380; 2382; 2399; 2411; 2458; 2459; 2462; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2943; 2944; 3043; 3057; 3092; 3286; 3384; 3387; 3596; 3600; 3690; 3782; 3810; 3811; 3822; 3857; 3904; 3920; 3940; 3958; 4076; 4093; 4094; 4096; 4130; 4295; 4297; 4345; 4351; 4428; 4434; 4442; 4468; 4493; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5067; 5080; 5144; 5198; 5221; 5238; 5380; 5383; 5450; 5532; 5555 (see Table 1).

This combination permits correctly classifying 93.3% of the samples.

2.4. Identification of a Predictive Panel of 280 Markers (PANEL 2)

The inventors have demonstrated a combination of 280 markers, linked to a KNN algorithm, based on the sequences SEQ ID Nos: 1; 6; 8; 28; 73; 80; 84; 90; 224; 314; 321; 323; 331; 343; 345; 349; 350; 352; 397; 417; 418; 429; 513; 538; 542; 600; 612; 629; 720; 723; 724; 738; 742; 788; 852; 978; 990; 991; 1107; 1152; 1154; 1169; 1212; 1237; 1239; 1242; 1260; 1295; 1326; 1489; 1490; 1511; 1641; 1683; 1694; 1711; 1714; 1723; 1731; 1732; 1741; 1744; 1747; 1749; 1789; 1800; 1806; 1831; 1833; 1834; 1836; 1837; 1859; 1861; 1950; 1951; 1952; 1953; 1984; 1985; 1994; 1995; 2022; 2023; 2038; 2090; 2091; 2117; 2126; 2127; 2128; 2129; 2130; 2132; 2133; 2143; 2144; 2192; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2562; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3056; 3057; 3061; 3070; 3092; 3173; 3221; 3242; 3265; 3286; 3384; 3387; 3388; 3429; 3487; 3500; 3520; 3574; 3576; 3596; 3600; 3673; 3688; 3690; 3732; 3751; 3767; 3782; 3807; 3809; 3810; 3811; 3819; 3820; 3822; 3857; 3862; 3904; 3920; 3936; 3940; 3950; 3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4592; 4596; 4603; 4607; 4676; 4706; 4736; 4744; 4804; 4807; 4860; 4885; 4886; 4887; 4888; 4889; 4890; 4891; 4892; 4895; 4897; 4898; 4899; 4918; 4955; 4975; 4976; 4978; 4979; 4982; 5000; 5017; 5031; 5067; 5080; 5109; 5125; 5144; 5147; 5188; 5196; 5198; 5221; 5238; 5247; 5249; 5305; 5333; 5373; 5380; 5383; 5416; 5450; 5501; 5519; 5521; 5529; 5532; 5534; 5555 (see Table 1).

This combination permits correctly classifying 93.0% of the samples.

2.5. Identification of a Predictive Panel of 260 Markers (PANEL 3)

The inventors have demonstrated a combination of 260 markers, linked to a KNN algorithm, based on the sequences SEQ ID Nos: 1; 6; 8; 28; 73; 80; 84; 90; 224; 314; 321; 323; 331; 343; 345; 349; 350; 352; 397; 417; 418; 429; 513; 538; 542; 600; 612; 629; 720; 723; 738; 742; 788; 852; 978; 990; 991; 1152; 1154; 1169; 1212; 1237; 1239; 1242; 1295; 1326; 1489; 1490; 1511; 1641; 1683; 1694; 1711; 1714; 1723; 1731; 1732; 1741; 1744; 1747; 1749; 1789; 1800; 1806; 1831; 1833; 1834; 1836; 1837; 1859; 1861; 1950; 1951; 1952; 1953; 1984; 1985; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2562; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3057; 3061; 3070; 3092; 3173; 3221; 3242; 3265; 3286; 3384; 3387; 3388; 3429; 3500; 3520; 3574; 3596; 3600; 3673; 3690; 3732; 3751; 3767; 3782; 3807; 3809; 3810; 3811; 3819; 3820; 3822; 3857; 3862; 3904; 3920; 3936; 3940; 3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4596; 4603; 4706; 4736; 4744; 4804; 4807; 4860; 4885; 4887; 4888; 4889; 4890; 4891; 4892; 4897; 4898; 4899; 4918; 4955; 4975; 4976; 4978; 4982; 5017; 5031; 5067; 5080; 5109; 5125; 5144; 5147; 5188; 5196; 5198; 5221; 5238; 5249; 5305; 5373; 5380; 5383; 5416; 5450; 5501; 5519; 5529; 5532; 5534; 5555 (see Table 1).

This combination permits correctly classifying 93.0% of the samples.

2.6. Identification of a Predictive Panel of 170 Markers (PANEL 4)

The inventors have demonstrated a combination of 170 markers, linked to a KNN algorithm, based on the sequences SEQ ID Nos: 1; 28; 73; 321; 323; 350; 397; 417; 418; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1950; 1951; 1952; 1953; 1984; 1994; 1995; 2023; 2038; 2117; 2126; 2127; 2128; 2129; 2130; 2133; 2144; 2284; 2305; 2365; 2372; 2375; 2378; 2380; 2382; 2399; 2406; 2411; 2458; 2459; 2462; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3596; 3600; 3690; 3782; 3807; 3810; 3811; 3822; 3857; 3862; 3904; 3920; 3940; 3958; 4019; 4076; 4093; 4094; 4096; 4130; 4295; 4297; 4345; 4351; 4428; 4434; 4442; 4468; 4493; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5067; 5080; 5144; 5198; 5221; 5238; 5380; 5383; 5450; 5532; 5555 (see Table 1).

This combination permits correctly classifying 93.0% of the samples.

2.7. Identification of a Predictive Panel of 200 Markers (PANEL 5)

The inventors have demonstrated a combination of 200 markers, linked to a KNN algorithm, based on the sequences SEQ ID Nos: 1; 6; 8; 28; 73; 90; 321; 323; 343; 350; 352; 397; 417; 418; 513; 538; 542; 600; 612; 720; 738; 788; 852; 990; 991; 1152; 1154; 1169; 1212; 1237; 1239; 1242; 1326; 1489; 1490; 1511; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3001; 3043; 3057; 3092; 3286; 3384; 3387; 3388; 3429; 3574; 3596; 3600; 3673; 3690; 3767; 3782; 3807; 3810; 3811; 3822; 3857; 3862; 3904; 3920; 3936; 3940; 3958; 3985; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.8% of the samples.

2.8. Identification of a Predictive Panel of 140 Markers (PANEL 6)

The inventors have demonstrated a combination of 140 markers, linked to a KNN algorithm, based on the sequences SEQ ID Nos: 1; 28; 73; 321; 323; 350; 417; 418; 720; 852; 990; 1152; 1154; 1169; 1212; 1237; 1239; 1242; 1326; 1489; 1490; 1683; 1694; 1711; 1723; 1731; 1741; 1744; 1749; 1800; 1833; 1834; 1837; 1951; 1952; 1953; 1984; 1995;

2023; 2038; 2117; 2126; 2127; 2128; 2129; 2130; 2133; 2144; 2284; 2305; 2365; 2372; 2378; 2380; 2382; 2399; 2411; 2459; 2462; 2528; 2529; 2532; 2533; 2542; 2543; 2556; 2563; 2564; 2652; 2679; 2703; 2709; 2725; 2727; 2732; 2740; 2887; 2888; 2900; 2941; 2943; 2944; 3043; 3057; 3286; 3387; 3596; 3600; 3690; 3782; 3810; 3811; 3822; 3857; 3904; 3920; 3940; 3958; 4076; 4093; 4094; 4096; 4130; 4295; 4345; 4351; 4428; 4434; 4442; 4468; 4493; 4510; 4546; 4603; 4744; 4804; 4860; 4885; 4888; 4889; 4890; 4891; 4892; 4897; 4898; 4899; 4918; 4955; 4975; 4976; 4978; 4982; 5144; 5198; 5221; 5238; 5380; 5383; 5450; 5532 (see Table 1).

This combination permits correctly classifying 92.8% of the samples.

2.9. Identification of a Predictive Panel of 110 Markers (PANEL 7)

The inventors have demonstrated a combination of 110 markers, linked to a KNN algorithm, based on the sequences SEQ ID Nos: 1; 28; 73; 321; 323; 418; 852; 1152; 1154; 1237; 1242; 1326; 1683; 1694; 1731; 1741; 1744; 1749; 1833; 1834; 1951; 1984; 1995; 2023; 2038; 2126; 2127; 2128; 2129; 2130; 2133; 2144; 2284; 2305; 2365; 2372; 2378; 2380; 2382; 2411; 2459; 2462; 2528; 2529; 2532; 2533; 2542; 2543; 2556; 2563; 2679; 2703; 2725; 2727; 2732; 2740; 2887; 2888; 2900; 2941; 2943; 2944; 3043; 3057; 3286; 3387; 3596; 3600; 3782; 3822; 3857; 3904; 3920; 3940; 3958; 4093; 4094; 4096; 4130; 4295; 4345; 4351; 4428; 4442; 4468; 4493; 4510; 4603; 4744; 4804; 4860; 4885; 4888; 4889; 4890; 4891; 4897; 4898; 4899; 4918; 4975; 4976; 4978; 4982; 5144; 5198; 5221; 5238; 5380; 5383 (see Table 1).

This combination permits correctly classifying 92.8% of the samples.

2.10. Identification of a Predictive Panel of 190 Markers (PANEL 8)

The inventors have demonstrated a combination of 190 markers, linked to a KNN algorithm, based on the sequences SEQ ID Nos: 1; 6; 28; 73; 321; 323; 343; 350; 352; 397; 417; 418; 513; 538; 542; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3767; 3782; 3807; 3810; 3811; 3822; 3857; 3862; 3904; 3920; 3936; 3940; 3958; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.8% of the samples.

2.11. Identification of a Predictive Panel of 240 Markers (PANEL 9)

The inventors have demonstrated a combination of 240 markers, linked to a KNN algorithm, based on the sequences SEQ ID Nos: 1; 6; 8; 28; 73; 80; 90; 224; 314; 321; 323; 331; 343; 345; 349; 350; 352; 397; 417; 418; 429; 513; 538; 542; 600; 612; 720; 723; 738; 742; 788; 852; 978; 990; 991; 1152; 1154; 1169; 1212; 1237; 1239; 1242; 1295; 1326; 1489; 1490; 1511; 1641; 1683; 1694; 1711; 1723; 1731; 1741; 1744; 1747; 1749; 1789; 1800; 1806; 1831; 1833; 1834; 1837; 1859; 1861; 1950; 1951; 1952; 1953; 1984; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2743; 2812; 2879; 2887; 2888; 2900; 2941; 2942; 2943; 2944; 2975; 3001; 3043; 3057; 3061; 3070; 3092; 3173; 3242; 3286; 3384; 3387; 3388; 3429; 3520; 3574; 3596; 3600; 3673; 3690; 3751; 3767; 3782; 3807; 3809; 3810; 3811; 3820; 3822; 3857; 3862; 3904; 3920; 3936; 3940; 3958; 3985; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4596; 4603; 4706; 4736; 4744; 4804; 4860; 4885; 4887; 4888; 4889; 4890; 4891; 4892; 4897; 4898; 4899; 4918; 4955; 4975; 4976; 4978; 4982; 5017; 5031; 5067; 5080; 5109; 5125; 5144; 5147; 5196; 5198; 5221; 5238; 5373; 5380; 5383; 5416; 5450; 5501; 5529; 5532; 5534; 5555 (see Table 1).

This combination permits correctly classifying 92.8% of the samples.

2.12. Identification of a Predictive Panel of 200 Markers (PANEL 10)

The inventors have demonstrated a combination of 200 markers, linked to a KNN algorithm, based on the sequences SEQ ID Nos: 1; 6; 8; 28; 73; 90; 321; 323; 343; 350; 352; 397; 417; 418; 513; 538; 542; 600; 612; 720; 738; 788; 852; 990; 991; 1152; 1154; 1169; 1212; 1237; 1239; 1242; 1326; 1489; 1490; 1511; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3001; 3043; 3057; 3092; 3286; 3384; 3387; 3388; 3429; 3574; 3596; 3600; 3673; 3690; 3767; 3782; 3807; 3810; 3811; 3822; 3857; 3862; 3904; 3920; 3936; 3940; 3958; 3985; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.5% of the samples.

2.13. Identification of a Predictive Panel of 190 Markers (PANEL 11)

The inventors have demonstrated a combination of 190 markers, linked to a KNN algorithm, based on the sequences SEQ ID Nos: 1; 6; 28; 73; 321; 323; 343; 350; 352; 397; 417; 418; 513; 538; 542; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564;

2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3767; 3782; 3807; 3810; 3811; 3822; 3857; 3862; 3904; 3920; 3936; 3940; 3958; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.5% of the samples.

2.14. Identification of a Predictive Panel of 210 Markers (PANEL 12)

The inventors have demonstrated a combination of 210 markers, linked to a KNN algorithm, based on the sequences SEQ ID Nos: 1; 6; 8; 28; 73; 90; 321; 323; 343; 345; 350; 352; 397; 417; 418; 513; 538; 542; 600; 612; 720; 738; 788; 852; 990; 991; 1152; 1154; 1169; 1212; 1237; 1239; 1242; 1326; 1489; 1490; 1511; 1641; 1683; 1694; 1711; 1723; 1731; 1741; 1744; 1747; 1749; 1789; 1800; 1806; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2743; 2887; 2888; 2900; 2941; 2942; 2943; 2944; 3001; 3043; 3057; 3092; 3173; 3286; 3384; 3387; 3388; 3429; 3574; 3596; 3600; 3673; 3690; 3767; 3782; 3807; 3810; 3811; 3820; 3822; 3857; 3862; 3904; 3920; 3936; 3940; 3958; 3985; 4019; 4076; 4093; 4094; 4096; 4130; 4295; 4297; 4345; 4350; 4351; 4399; 4428; 4434; 4442; 4468; 4493; 4497; 4510; 4515; 4546; 4596; 4603; 4706; 4736; 4744; 4804; 4860; 4885; 4887; 4888; 4889; 4890; 4891; 4892; 4897; 4898; 4899; 4918; 4955; 4975; 4976; 4978; 4982; 5017; 5067; 5080; 5144; 5147; 5198; 5221; 5238; 5373; 5380; 5383; 5416; 5450; 5529; 5532; 5555 (see Table 1).

This combination permits correctly classifying 92.5% of the samples.

2.15. Identification of a Predictive Panel of 260 Markers (PANEL 13)

The inventors have demonstrated a combination of 260 markers, linked to a KNN algorithm, based on the sequences SEQ ID Nos: 1; 6; 8; 28; 73; 80; 84; 90; 224; 314; 321; 323; 331; 343; 345; 349; 350; 352; 397; 417; 418; 429; 513; 538; 542; 600; 612; 629; 720; 723; 738; 742; 788; 852; 978; 990; 991; 1152; 1154; 1169; 1212; 1237; 1239; 1242; 1295; 1326; 1489; 1490; 1511; 1641; 1683; 1694; 1711; 1714; 1723; 1731; 1732; 1741; 1744; 1747; 1749; 1789; 1800; 1806; 1831; 1833; 1834; 1836; 1837; 1859; 1861; 1950; 1951; 1952; 1953; 1984; 1985; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2562; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3057; 3061; 3070; 3092; 3173; 3221; 3242; 3265; 3286; 3384; 3387; 3388; 3429; 3500; 3520; 3574; 3596; 3600; 3673; 3690; 3732; 3751; 3767; 3782; 3807; 3809; 3810; 3811; 3819; 3820; 3822; 3857; 3862; 3904; 3920; 3936; 3940; 3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4596; 4603; 4706; 4736; 4744; 4804; 4807; 4860; 4885; 4887; 4888; 4889; 4890; 4891; 4892; 4897; 4898; 4899; 4918; 4955; 4975; 4976; 4978; 4982; 5017; 5031; 5067; 5080; 5109; 5125; 5144; 5147; 5188; 5196; 5198; 5221; 5238; 5249; 5305; 5373; 5380; 5383; 5416; 5450; 5501; 5519; 5529; 5532; 5534; 5555 (see Table 1).

This combination permits correctly classifying 92.5% of the samples.

2.16. Identification of a Predictive Panel of 180 Markers (PANEL 14)

The inventors have demonstrated a combination of 180 markers, linked to a KNN algorithm, based on the sequences SEQ ID Nos: 1; 28; 73; 321; 323; 350; 352; 397; 417; 418; 513; 538; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2133; 2143; 2144; 2284; 2305; 2365; 2372; 2375; 2378; 2380; 2382; 2390; 2399; 2406; 2411; 2458; 2459; 2462; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3782; 3807; 3810; 3811; 3822; 3857; 3862; 3904; 3920; 3936; 3940; 3958; 4019; 4076; 4093; 4094; 4096; 4130; 4295; 4297; 4345; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5067; 5080; 5144; 5198; 5221; 5238; 5380; 5383; 5450; 5532; 5555 (see Table 1).

This combination permits correctly classifying 92.5% of the samples.

2.17. Identification of a Predictive Panel of 190 Markers (PANEL 15)

The inventors have demonstrated a combination of 190 markers, linked to a KNN algorithm, based on the sequences SEQ ID Nos: 1; 6; 28; 73; 321; 323; 343; 350; 352; 397; 417; 418; 513; 538; 542; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3767; 3782; 3807; 3810; 3811; 3822; 3857; 3862; 3904; 3920; 3936; 3940; 3958; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.5% of the samples.

2.18. Identification of a Predictive Panel of 250 Markers (PANEL 16)

The inventors have demonstrated a combination of 250 markers, linked to a KNN algorithm, based on the sequences SEQ ID Nos: 1; 6; 8; 28; 73; 80; 90; 224; 314; 321; 323; 331;

343; 345; 349; 350; 352; 397; 417; 418; 429; 513; 538; 542; 600; 612; 629; 720; 723; 738; 742; 788; 852; 978; 990; 991; 1152; 1154; 1169; 1212; 1237; 1239; 1242; 1295; 1326; 1489; 1490; 1511; 1641; 1683; 1694; 1711; 1723; 1731; 1732; 1741; 1744; 1747; 1749; 1789; 1800; 1806; 1831; 1833; 1834; 1837; 1859; 1861; 1950; 1951; 1952; 1953; 1984; 1985; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3057; 3061; 3070; 3092; 3173; 3221; 3242; 3286; 3384; 3387; 3388; 3429; 3520; 3574; 3596; 3600; 3673; 3690; 3751; 3767; 3782; 3807; 3809; 3810; 3811; 3819; 3820; 3822; 3857; 3862; 3904; 3920; 3936; 3940; 3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4596; 4603; 4706; 4736; 4744; 4804; 4807; 4860; 4885; 4887; 4888; 4889; 4890; 4891; 4892; 4897; 4898; 4899; 4918; 4955; 4975; 4976; 4978; 4982; 5017; 5031; 5067; 5080; 5109; 5125; 5144; 5147; 5188; 5196; 5198; 5221; 5238; 5373; 5380; 5383; 5416; 5450; 5501; 5529; 5532; 5534; 5555 (see Table 1).

This combination permits correctly classifying 92.5% of the samples.

2.19. Identification of a Predictive Panel of 250 Markers (PANEL 17)

The inventors have demonstrated a combination of 250 markers, linked to a KNN algorithm, based on the sequences SEQ ID Nos: 1; 6; 8; 28; 73; 80; 90; 224; 314; 321; 323; 331; 343; 345; 349; 350; 352; 397; 417; 418; 429; 513; 538; 542; 600; 612; 629; 720; 723; 738; 742; 788; 852; 978; 990; 991; 1152; 1154; 1169; 1212; 1237; 1239; 1242; 1295; 1326; 1489; 1490; 1511; 1641; 1683; 1694; 1711; 1723; 1731; 1732; 1741; 1744; 1747; 1749; 1789; 1800; 1806; 1831; 1833; 1834; 1837; 1859; 1861; 1950; 1951; 1952; 1953; 1984; 1985; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3057; 3061; 3070; 3092; 3173; 3221; 3242; 3286; 3384; 3387; 3388; 3429; 3520; 3574; 3596; 3600; 3673; 3690; 3751; 3767; 3782; 3807; 3809; 3810; 3811; 3819; 3820; 3822; 3857; 3862; 3904; 3920; 3936; 3940; 3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4596; 4603; 4706; 4736; 4744; 4804; 4807; 4860; 4885; 4887; 4888; 4889; 4890; 4891; 4892; 4897; 4898; 4899; 4918; 4955; 4975; 4976; 4978; 4982; 5017; 5031; 5067; 5080; 5109; 5125; 5144; 5147; 5188; 5196; 5198; 5221; 5238; 5373; 5380; 5383; 5416; 5450; 5501; 5529; 5532; 5534; 5555 (see Table 1).

This combination permits correctly classifying 92.5% of the samples.

2.20. Identification of a Predictive Panel of 110 Markers (PANEL 18)

The inventors have demonstrated a combination of 110 markers, linked to a KNN algorithm, based on the sequences SEQ ID Nos: 1; 28; 73; 321; 323; 418; 852; 1152; 1154; 1237; 1242; 1326; 1683; 1694; 1731; 1741; 1744; 1749; 1833; 1834; 1951; 1984; 1995; 2023; 2038; 2126; 2127; 2128; 2129; 2130; 2133; 2144; 2284; 2305; 2365; 2372; 2378; 2380; 2382; 2411; 2459; 2462; 2528; 2529; 2532; 2533; 2542; 2543; 2556; 2563; 2679; 2703; 2725; 2727; 2732; 2740; 2887; 2888; 2900; 2941; 2943; 2944; 3043; 3057; 3286; 3387; 3596; 3600; 3782; 3822; 3857; 3904; 3920; 3940; 3958; 4093; 4094; 4096; 4130; 4295; 4345; 4351; 4428; 4442; 4468; 4493; 4510; 4603; 4744; 4804; 4860; 4885; 4888; 4889; 4890; 4891; 4897; 4898; 4899; 4918; 4975; 4976; 4978; 4982; 5144; 5198; 5221; 5238; 5380; 5383 (see Table 1).

This combination permits correctly classifying 92.5% of the samples.

2.21. Identification of a Predictive Panel of 220 Markers (PANEL 19)

The inventors have demonstrated a combination of 220 markers, linked to a KNN algorithm, based on the sequences SEQ ID Nos: 1; 6; 8; 28; 73; 80; 90; 321; 323; 343; 345; 350; 352; 397; 417; 418; 513; 538; 542; 600; 612; 720; 738; 788; 852; 978; 990; 991; 1152; 1154; 1169; 1212; 1237; 1239; 1242; 1295; 1326; 1489; 1490; 1511; 1641; 1683; 1694; 1711; 1723; 1731; 1741; 1744; 1747; 1749; 1789; 1800; 1806; 1831; 1833; 1834; 1837; 1859; 1950; 1951; 1952; 1953; 1984; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2743; 2812; 2887; 2888; 2900; 2941; 2942; 2943; 2944; 3001; 3043; 3057; 3061; 3092; 3173; 3242; 3286; 3384; 3387; 3388; 3429; 3574; 3596; 3600; 3673; 3690; 3767; 3782; 3807; 3810; 3811; 3820; 3822; 3857; 3862; 3904; 3920; 3936; 3940; 3958; 3985; 4019; 4051; 4076; 4093; 4094; 4096; 4130; 4295; 4297; 4345; 4350; 4351; 4399; 4428; 4434; 4442; 4468; 4493; 4497; 4510; 4515; 4546; 4596; 4603; 4706; 4736; 4744; 4804; 4860; 4885; 4887; 4888; 4889; 4890; 4891; 4892; 4897; 4898; 4899; 4918; 4955; 4975; 4976; 4978; 4982; 5017; 5067; 5080; 5144; 5147; 5198; 5221; 5238; 5373; 5380; 5383; 5416; 5450; 5529; 5532; 5534; 5555 (see Table 1).

This combination permits correctly classifying 92.5% of the samples.

2.22. Identification of a Predictive Panel of 270 Markers (PANEL 20)

The inventors have demonstrated a combination of 270 markers, linked to a KNN algorithm, based on the sequences SEQ ID Nos: 1; 6; 8; 28; 73; 80; 84; 90; 224; 314; 321; 323; 331; 343; 345; 349; 350; 352; 397; 417; 418; 429; 513; 538; 542; 600; 612; 629; 720; 723; 724; 738; 742; 788; 852; 978; 990; 991; 1107; 1152; 1154; 1169; 1212; 1237; 1239; 1242; 1260; 1295; 1326; 1489; 1490; 1511; 1641; 1683; 1694; 1711; 1714; 1723; 1731; 1732; 1741; 1744; 1747; 1749; 1789; 1800; 1806; 1831; 1833; 1834; 1836; 1837; 1859; 1861; 1950; 1951; 1952; 1953; 1984; 1985; 1994; 1995; 2023; 2038; 2090; 2091; 2117; 2126; 2127; 2128; 2129; 2130; 2132; 2133; 2143; 2144; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2562; 2563; 2564; 2575; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3056; 3057; 3061; 3070; 3092; 3173; 3221; 3242; 3265; 3286; 3384; 3387; 3388; 3429; 3500; 3520; 3574; 3576; 3596; 3600; 3673; 3690; 3732; 3751; 3767; 3782; 3807; 3809; 3810; 3811; 3819; 3820; 3822; 3857; 3862; 3904; 3920; 3936; 3940; 3950;

3958; 3985; 4017; 4019; 4051; 4076; 4093; 4094; 4096; 4130; 4295; 4297; 4345; 4350; 4351; 4399; 4428; 4434; 4442; 4468; 4493; 4497; 4510; 4515; 4523; 4546; 4592; 4596; 4603; 4706; 4736; 4744; 4804; 4807; 4860; 4885; 4887; 4888; 4889; 4890; 4891; 4892; 4897; 4898; 4899; 4918; 4955; 4975; 4976; 4978; 4979; 4982; 5017; 5031; 5067; 5080; 5109; 5125; 5144; 5147; 5188; 5196; 5198; 5221; 5238; 5249; 5305; 5333; 5373; 5380; 5383; 5416; 5450; 5501; 5519; 5521; 5529; 5532; 5534; 5555 (see Table 1).

This combination permits correctly classifying 92.5% of the samples.

2.23. Identification of a Predictive Panel of 290 Markers (PANEL 21)

The inventors have demonstrated a combination of 290 markers, linked to a KNN algorithm, based on the sequences SEQ ID Nos: 1; 6; 8; 28; 55; 73; 80; 84; 90; 224; 314; 321; 323; 331; 343; 345; 349; 350; 352; 397; 417; 418; 429; 513; 538; 542; 600; 612; 629; 720; 723; 724; 738; 742; 788; 852; 978; 990; 991; 1107; 1152; 1154; 1169; 1212; 1237; 1239; 1242; 1260; 1295; 1326; 1489; 1490; 1511; 1641; 1683; 1694; 1699; 1711; 1714; 1723; 1731; 1732; 1741; 1744; 1747; 1749; 1789; 1800; 1806; 1831; 1833; 1834; 1836; 1837; 1859; 1861; 1950; 1951; 1952; 1953; 1984; 1985; 1994; 1995; 2022; 2023; 2038; 2090; 2091; 2117; 2126; 2127; 2128; 2129; 2130; 2132; 2133; 2143; 2144; 2192; 2209; 2284; 2305; 2365; 2372; 2374; 2375; 2378; 2380; 2382; 2390; 2399; 2406; 2411; 2458; 2459; 2462; 2469; 2528; 2529; 2532; 2533; 2534; 2538; 2542; 2543; 2556; 2562; 2563; 2564; 2575; 2590; 2652; 2679; 2703; 2708; 2709; 2725; 2727; 2732; 2740; 2743; 2812; 2879; 2887; 2888; 2900; 2941; 2942; 2943; 2944; 2975; 3001; 3018; 3043; 3056; 3057; 3061; 3070; 3092; 3172; 3173; 3221; 3242; 3265; 3286; 3384; 3387; 3388; 3429; 3487; 3500; 3520; 3574; 3576; 3596; 3600; 3673; 3688; 3690; 3732; 3751; 3767; 3782; 3807; 3809; 3810; 3811; 3819; 3820; 3822; 3857; 3862; 3904; 3920; 3936; 3940; 3950; 3958; 3985; 3996; 4017; 4019; 4051; 4076; 4093; 4094; 4096; 4130; 4295; 4297; 4343; 4345; 4350; 4351; 4399; 4428; 4434; 4442; 4468; 4493; 4497; 4498; 4510; 4515; 4523; 4546; 4592; 4596; 4603; 4607; 4676; 4706; 4736; 4744; 4804; 4807; 4860; 4885; 4886; 4887; 4888; 4889; 4890; 4891; 4892; 4895; 4897; 4898; 4899; 4918; 4955; 4975; 4976; 4978; 4979; 4982; 4986; 5000; 5017; 5031; 5067; 5080; 5109; 5125; 5144; 5147; 5188; 5196; 5198; 5221; 5237; 5238; 5239; 5247; 5249; 5305; 5333; 5373; 5380; 5383; 5416; 5450; 5501; 5519; 5521; 5529; 5532; 5534; 5555 (see Table 1).

This combination permits correctly classifying 92.5% of the samples.

2.24. Identification of a Predictive Panel of 270 Markers (PANEL 22)

The inventors have demonstrated a combination of 270 markers, linked to an SVM algorithm, based on the sequences SEQ ID Nos: 26; 51; 52; 58; 63; 75; 98; 101; 103; 105; 114; 117; 120; 163; 166; 171; 172; 277; 278; 300; 325; 338; 354; 397; 398; 401; 403; 407; 419; 421; 424; 482; 511; 512; 518; 527; 531; 539; 569; 570; 571; 591; 596; 597; 598; 614; 619; 629; 658; 662; 668; 689; 690; 691; 694; 719; 721; 722; 789; 842; 872; 949; 958; 1032; 1033; 1159; 1162; 1166; 1169; 1174; 1214; 1218; 1220; 1229; 1237; 1238; 1240; 1242; 1253; 1257; 1258; 1259; 1270; 1307; 1308; 1346; 1348; 1398; 1432; 1440; 1494; 1495; 1522; 1523; 1551; 1561; 1588; 1624; 1632; 1654; 1668; 1674; 1701; 1724; 1744; 1767; 1786; 1809; 1811; 1841; 1853; 1859; 1951; 1986; 2001; 2003; 2007; 2009; 2010; 2011; 2106; 2107; 2110; 2111; 2112; 2114; 2115; 2144; 2148; 2158; 2185; 2249; 2250; 2251; 2252; 2253; 2260; 2263; 2269; 2281; 2307; 2310; 2320; 2333; 2349; 2350; 2400; 2421; 2442; 2462; 2519; 2594; 2599; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3566; 3567; 3575; 3625; 3626; 3672; 3685; 3782; 3814; 3816; 3824; 3828; 3842; 3846; 3847; 3848; 3897; 3912; 3933; 3960; 3987; 3993; 4172; 4182; 4183; 4192; 4233; 4257; 4281; 4370; 4381; 4419; 4425; 4428; 4429; 4468; 4480; 4489; 4502; 4507; 4553; 4574; 4575; 4587; 4622; 4660; 4665; 4711; 4721; 4722; 4736; 4857; 4872; 4900; 4961; 5019; 5027; 5049; 5107; 5141; 5161; 5176; 5183; 5184; 5268; 5272; 5273; 5331; 5334; 5343; 5375; 5391; 5417; 5470; 5529 (see Table 1).

This combination permits correctly classifying 96.2% of the samples.

2.25. Identification of a Predictive Panel of 250 Markers (PANEL 23)

The inventors have demonstrated a combination of 250 markers, linked to an SVM algorithm, based on the sequences SEQ ID Nos: 26; 52; 58; 75; 98; 101; 103; 105; 114; 120; 163; 166; 171; 172; 277; 278; 300; 325; 354; 397; 398; 401; 403; 407; 419; 421; 424; 482; 511; 512; 518; 527; 531; 539; 569; 570; 571; 591; 596; 597; 598; 614; 619; 629; 658; 662; 668; 689; 690; 691; 694; 719; 721; 722; 789; 842; 872; 949; 1033; 1159; 1162; 1166; 1169; 1174; 1214; 1218; 1220; 1229; 1237; 1238; 1240; 1242; 1253; 1257; 1258; 1259; 1270; 1307; 1308; 1346; 1348; 1398; 1432; 1440; 1494; 1495; 1522; 1523; 1551; 1561; 1588; 1632; 1654; 1668; 1674; 1701; 1724; 1744; 1786; 1809; 1811; 1841; 1853; 1859; 1951; 1986; 2001; 2007; 2009; 2010; 2011; 2107; 2110; 2111; 2112; 2114; 2115; 2144; 2148; 2158; 2185; 2249; 2250; 2251; 2252; 2253; 2260; 2263; 2269; 2281; 2307; 2310; 2320; 2333; 2349; 2350; 2400; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3912; 3933; 3960; 3987; 3993; 4172; 4182; 4183; 4192; 4233; 4257; 4281; 4370; 4381; 4419; 4425; 4428; 4429; 4468; 4480; 4489; 4502; 4507; 4553; 4574; 4587; 4622; 4660; 4722; 4736; 4872; 4900; 4961; 5019; 5027; 5049; 5107; 5141; 5176; 5183; 5184; 5268; 5272; 5273; 5331; 5334; 5343; 5375; 5391; 5417; 5470; 5529 (see Table 1).

This combination permits correctly classifying 96.0% of the samples.

2.26. Identification of a Predictive Panel of 260 Markers (PANEL 24)

The inventors have demonstrated a combination of 260 markers, linked to an SVM algorithm, based on the sequences SEQ ID Nos: 26; 52; 58; 63; 75; 98; 101; 103; 105; 114; 117; 120; 163; 166; 171; 172; 277; 278; 300; 325; 338; 354; 397; 398; 401; 403; 407; 419; 421; 424; 482; 511; 512; 518; 527; 531; 539; 569; 570; 571; 591; 596; 597; 598; 614; 619; 629; 658; 662; 668; 689; 690; 691; 694; 719; 721; 722; 789; 842; 872; 949; 1033; 1159; 1162; 1166; 1169; 1174; 1214; 1218; 1220; 1229; 1237; 1238; 1240; 1242; 1253; 1257; 1258; 1259; 1270; 1307; 1308; 1346; 1348; 1398; 1432; 1440; 1494; 1495; 1522; 1523; 1551; 1561; 1588; 1624; 1632; 1654; 1668; 1674; 1701; 1724; 1744; 1786; 1809; 1811; 1841; 1853; 1859; 1951; 1986; 2001; 2003; 2007; 2009; 2010; 2011; 2107; 2110; 2111; 2112; 2114; 2115; 2144;

2148; 2158; 2185; 2249; 2250; 2251; 2252; 2253; 2260; 2263; 2269; 2281; 2307; 2310; 2320; 2333; 2349; 2350; 2400; 2421; 2442; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3566; 3567; 3575; 3625; 3626; 3672; 3685; 3782; 3814; 3816; 3824; 3828; 3842; 3846; 3847; 3848; 3897; 3912; 3933; 3960; 3987; 3993; 4172; 4182; 4183; 4192; 4233; 4257; 4281; 4370; 4381; 4419; 4425; 4428; 4429; 4468; 4480; 4489; 4502; 4507; 4553; 4574; 4575; 4587; 4622; 4660; 4711; 4722; 4736; 4872; 4900; 4961; 5019; 5027; 5049; 5107; 5141; 5176; 5183; 5184; 5268; 5272; 5273; 5331; 5334; 5343; 5375; 5391; 5417; 5470; 5529 (see Table 1).

This combination permits correctly classifying 96.0% of the samples.

2.27. Identification of a Predictive Panel of 230 Markers (PANEL 25)

The inventors have demonstrated a combination of 230 markers, linked to an SVM algorithm, based on the sequences SEQ ID Nos: 26; 52; 58; 75; 98; 101; 103; 105; 114; 120; 163; 166; 171; 172; 277; 278; 300; 325; 354; 397; 398; 403; 407; 419; 421; 424; 482; 511; 512; 518; 527; 531; 539; 569; 570; 571; 591; 596; 597; 598; 614; 619; 629; 658; 662; 689; 690; 691; 694; 719; 721; 872; 949; 1033; 1159; 1162; 1166; 1169; 1174; 1214; 1218; 1229; 1237; 1238; 1240; 1242; 1257; 1258; 1259; 1270; 1307; 1308; 1346; 1348; 1398; 1432; 1440; 1494; 1495; 1522; 1523; 1551; 1561; 1588; 1632; 1654; 1668; 1674; 1724; 1744; 1786; 1809; 1841; 1853; 1859; 1951; 1986; 2001; 2007; 2009; 2010; 2011; 2110; 2111; 2115; 2144; 2148; 2158; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3933; 3960; 3987; 3993; 4172; 4182; 4183; 4192; 4233; 4257; 4281; 4381; 4419; 4425; 4428; 4429; 4468; 4480; 4489; 4502; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5375; 5391; 5417; 5529 (see Table 1).

This combination permits correctly classifying 96.0% of the samples.

2.28. Identification of a Predictive Panel of 240 Markers (PANEL 26)

The inventors have demonstrated a combination of 240 markers, linked to an SVM algorithm, based on the sequences SEQ ID Nos: 26; 52; 58; 75; 98; 101; 103; 105; 114; 120; 163; 166; 171; 172; 277; 278; 300; 325; 354; 397; 398; 403; 407; 419; 421; 424; 482; 511; 512; 518; 527; 531; 539; 569; 570; 571; 591; 596; 597; 598; 614; 619; 629; 658; 662; 668; 689; 690; 691; 694; 719; 721; 722; 789; 872; 949; 1033; 1159; 1162; 1166; 1169; 1174; 1214; 1218; 1220; 1229; 1237; 1238; 1240; 1242; 1257; 1258; 1259; 1270; 1307; 1308; 1346; 1348; 1398; 1432; 1440; 1494; 1495; 1522; 1523; 1551; 1561; 1588; 1632; 1654; 1668; 1674; 1724; 1744; 1786; 1809; 1841; 1853; 1859; 1951; 1986; 2001; 2007; 2009; 2010; 2011; 2110; 2111; 2115; 2144; 2148; 2158; 2185; 2249; 2250; 2251; 2252; 2253; 2260; 2263; 2269; 2281; 2307; 2310; 2320; 2333; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3912; 3933; 3960; 3987; 3993; 4172; 4182; 4183; 4192; 4233; 4257; 4281; 4370; 4381; 4419; 4425; 4428; 4429; 4468; 4480; 4489; 4502; 4507; 4553; 4574; 4587; 4622; 4660; 4722; 4736; 4872; 4900; 4961; 5019; 5027; 5049; 5107; 5141; 5176; 5183; 5184; 5268; 5272; 5331; 5334; 5343; 5375; 5391; 5417; 5470; 5529 (see Table 1).

This combination permits correctly classifying 95.8% of the samples.

2.29. Identification of a Predictive Panel of 280 Markers (PANEL 27)

The inventors have demonstrated a combination of 280 markers, linked to an SVM algorithm, based on the sequences SEQ ID Nos: 26; 51; 52; 58; 63; 75; 98; 101; 103; 105; 114; 117; 120; 163; 166; 171; 172; 277; 278; 300; 325; 338; 354; 397; 398; 401; 403; 407; 419; 421; 424; 482; 511; 512; 518; 527; 531; 539; 569; 570; 571; 591; 596; 597; 598; 614; 619; 629; 658; 662; 668; 689; 690; 691; 694; 719; 721; 722; 789; 842; 872; 921; 949; 958; 1032; 1033; 1159; 1162; 1166; 1169; 1174; 1185; 1214; 1218; 1220; 1229; 1237; 1238; 1240; 1242; 1253; 1257; 1258; 1259; 1270; 1307; 1308; 1346; 1348; 1398; 1432; 1440; 1494; 1495; 1522; 1523; 1551; 1561; 1588; 1624; 1632; 1654; 1668; 1674; 1701; 1724; 1744; 1767; 1786; 1809; 1811; 1841; 1853; 1859; 1951; 1986; 2001; 2003; 2007; 2009; 2010; 2011; 2106; 2107; 2110; 2111; 2112; 2114; 2115; 2144; 2148; 2158; 2185; 2249; 2250; 2251; 2252; 2253; 2260; 2263; 2269; 2281; 2307; 2310; 2320; 2333; 2349; 2350; 2400; 2421; 2442; 2462; 2519; 2594; 2599; 2604; 2619; 2620; 2621; 2622; 2813; 2835; 2838; 2869; 2873; 2887; 2888; 2889; 2891; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3520; 3525; 3527; 3531; 3565; 3566; 3567; 3575; 3624; 3625; 3626; 3672; 3685; 3782; 3814; 3816; 3824; 3826; 3828; 3842; 3843; 3846; 3847; 3848; 3897; 3912; 3933; 3960; 3987; 3993; 4065; 4172; 4182; 4183; 4192; 4233; 4257; 4281; 4370; 4381; 4419; 4425; 4428; 4429; 4468; 4480; 4489; 4502; 4507; 4553; 4574; 4575; 4587; 4622; 4660; 4665; 4700; 4711; 4721; 4722; 4736; 4857; 4872; 4900; 4961; 5019; 5027; 5049; 5107; 5123; 5141; 5161; 5176; 5183; 5184; 5268; 5272; 5273; 5331; 5334; 5343; 5375; 5391; 5417; 5470; 5529 (see Table 1).

This combination permits correctly classifying 95.8% of the samples.

2.30. Identification of a Predictive Panel of 290 Markers (PANEL 28)

The inventors have demonstrated a combination of 290 markers, linked to an SVM algorithm, based on the sequences SEQ ID Nos: 26; 51; 52; 58; 63; 75; 98; 101; 103; 105; 114; 117; 120; 163; 166; 171; 172; 277; 278; 300; 325; 338; 354; 397; 398; 401; 403; 407; 419; 421; 424; 480; 482; 511; 512; 518; 527; 531; 539; 569; 570; 571; 591; 596; 597; 598; 614; 619; 629; 658; 662; 668; 689; 690; 691; 693; 694; 719; 721; 722; 789; 842; 871; 872; 921; 949; 958; 1032; 1033; 1159; 1162; 1166; 1169; 1174; 1185; 1214; 1218; 1220; 1229; 1237; 1238; 1240; 1242; 1253; 1257; 1258; 1259; 1270; 1307; 1308; 1346; 1348; 1398; 1432; 1440; 1494; 1495; 1522; 1523; 1551; 1561; 1588; 1624; 1632; 1654; 1668; 1674; 1701; 1724; 1744; 1767; 1786; 1809; 1811; 1841; 1853; 1859; 1951; 1986; 2001; 2003; 2007; 2009; 2010; 2011; 2085; 2106; 2107; 2110; 2111; 2112; 2114; 2115;

2144; 2148; 2158; 2185; 2249; 2250; 2251; 2252; 2253; 2260; 2263; 2269; 2281; 2307; 2310; 2320; 2333; 2349; 2350; 2400; 2421; 2442; 2462; 2519; 2594; 2596; 2599; 2604; 2619; 2620; 2621; 2622; 2679; 2813; 2835; 2838; 2869; 2873; 2887; 2888; 2889; 2891; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3520; 3525; 3527; 3531; 3565; 3566; 3567; 3573; 3574; 3575; 3624; 3625; 3626; 3672; 3685; 3782; 3814; 3816; 3824; 3826; 3828; 3842; 3843; 3846; 3847; 3848; 3897; 3912; 3933; 3960; 3987; 3993; 4065; 4172; 4182; 4183; 4192; 4199; 4233; 4257; 4281; 4370; 4381; 4419; 4425; 4428; 4429; 4468; 4480; 4489; 4502; 4507; 4553; 4574; 4575; 4587; 4622; 4660; 4665; 4700; 4711; 4712; 4721; 4722; 4736; 4857; 4872; 4900; 4961; 5019; 5027; 5049; 5107; 5123; 5141; 5161; 5176; 5183; 5184; 5268; 5272; 5273; 5331; 5334; 5343; 5375; 5391; 5417; 5470; 5529 (see Table 1).

This combination permits correctly classifying 95.8% of the samples.

2.31. Identification of a Predictive Panel of 220 Markers (PANEL 29)

The inventors have demonstrated a combination of 220 markers, linked to an SVM algorithm, based on the sequences SEQ ID Nos: 26; 52; 58; 75; 98; 103; 105; 114; 120; 163; 166; 171; 172; 277; 278; 300; 325; 354; 397; 398; 407; 419; 421; 424; 482; 511; 512; 518; 527; 539; 569; 570; 571; 591; 596; 597; 598; 614; 619; 629; 658; 662; 689; 691; 694; 719; 721; 872; 949; 1033; 1159; 1162; 1166; 1169; 1174; 1214; 1218; 1229; 1237; 1238; 1240; 1242; 1257; 1258; 1259; 1270; 1307; 1308; 1346; 1348; 1398; 1432; 1440; 1494; 1495; 1522; 1523; 1551; 1588; 1632; 1654; 1668; 1674; 1724; 1744; 1786; 1809; 1841; 1853; 1859; 1951; 1986; 2001; 2007; 2009; 2010; 2011; 2110; 2115; 2144; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3933; 3960; 3987; 3993; 4172; 4182; 4192; 4233; 4257; 4281; 4381; 4419; 4425; 4428; 4429; 4468; 4480; 4489; 4502; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5375; 5391; 5417; 5529 (see Table 1).

This combination permits correctly classifying 95.8% of the samples.

2.32. Identification of a Predictive Panel of 200 Markers (PANEL 30)

The inventors have demonstrated a combination of 200 markers, linked to an SVM algorithm, based on the sequences SEQ ID Nos: 26; 52; 58; 75; 103; 105; 120; 163; 166; 171; 172; 277; 278; 300; 325; 354; 397; 398; 419; 421; 424; 482; 512; 518; 527; 539; 569; 570; 571; 591; 596; 597; 598; 614; 619; 629; 658; 662; 689; 694; 719; 721; 872; 949; 1033; 1159; 1162; 1166; 1174; 1214; 1218; 1229; 1237; 1238; 1240; 1242; 1258; 1259; 1270; 1307; 1308; 1346; 1348; 1432; 1440; 1494; 1495; 1522; 1523; 1588; 1632; 1654; 1668; 1674; 1724; 1744; 1786; 1841; 1853; 1859; 1951; 1986; 2001; 2007; 2009; 2010; 2110; 2115; 2144; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3266; 3304; 3340; 3376; 3430; 3508; 3525; 3527; 3531; 3565; 3567; 3575; 3625; 3672; 3685; 3782; 3814; 3824; 3828; 3842; 3846; 3847; 3848; 3897; 3960; 3993; 4172; 4182; 4192; 4233; 4257; 4281; 4381; 4419; 4425; 4428; 4429; 4468; 4489; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5391; 5417; 5529 (see Table 1).

This combination permits correctly classifying 95.8% of the samples.

2.33. Identification of a Predictive Panel of 230 Markers (PANEL 31)

The inventors have demonstrated a combination of 230 markers, linked to an SVM algorithm, based on the sequences SEQ ID Nos: 26; 52; 58; 75; 98; 101; 103; 105; 114; 120; 163; 166; 171; 172; 277; 278; 300; 325; 354; 397; 398; 403; 407; 419; 421; 424; 482; 511; 512; 518; 527; 531; 539; 569; 570; 571; 591; 596; 597; 598; 614; 619; 629; 658; 662; 689; 690; 691; 694; 719; 721; 872; 949; 1033; 1159; 1162; 1166; 1169; 1174; 1214; 1218; 1229; 1237; 1238; 1240; 1242; 1257; 1258; 1259; 1270; 1307; 1308; 1346; 1348; 1398; 1432; 1440; 1494; 1495; 1522; 1523; 1551; 1561; 1588; 1632; 1654; 1668; 1674; 1724; 1744; 1786; 1809; 1841; 1853; 1859; 1951; 1986; 2001; 2007; 2009; 2010; 2011; 2110; 2111; 2115; 2144; 2148; 2158; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3933; 3960; 3987; 3993; 4172; 4182; 4183; 4192; 4233; 4257; 4281; 4381; 4419; 4425; 4428; 4429; 4468; 4480; 4489; 4502; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5375; 5391; 5417; 5529 (see Table 1).

This combination permits correctly classifying 95.8% of the samples.

2.34. Identification of a Predictive Panel of 230 Markers (PANEL 32)

The inventors have demonstrated a combination of 230 markers, linked to an SVM algorithm, based on the sequences SEQ ID Nos: 26; 52; 58; 75; 98; 101; 103; 105; 114; 120; 163; 166; 171; 172; 277; 278; 300; 325; 354; 397; 398; 403; 407; 419; 421; 424; 482; 511; 512; 518; 527; 531; 539; 569; 570; 571; 591; 596; 597; 598; 614; 619; 629; 658; 662; 689; 690; 691; 694; 719; 721; 872; 949; 1033; 1159; 1162; 1166; 1169; 1174; 1214; 1218; 1229; 1237; 1238; 1240; 1242; 1257; 1258; 1259; 1270; 1307; 1308; 1346; 1348; 1398; 1432; 1440; 1494; 1495; 1522; 1523; 1551; 1561; 1588; 1632; 1654; 1668; 1674; 1724; 1744; 1786; 1809; 1841; 1853; 1859; 1951; 1986; 2001; 2007; 2009; 2010; 2011; 2110; 2111; 2115; 2144; 2148; 2158; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3296; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3933; 3960; 3987; 3993; 4172; 4182; 4183; 4192; 4233; 4257; 4281; 4381; 4419; 4425; 4428; 4429; 4468; 4480; 4489;

4502; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5375; 5391; 5417; 5529 (see Table 1).

This combination permits correctly classifying 95.8% of the samples.

2.35. Identification of a Predictive Panel of 300 Markers (PANEL 33)

The inventors have demonstrated a combination of 300 markers, linked to an SVM algorithm, based on the sequences SEQ ID Nos: 26; 51; 52; 58; 63; 75; 98; 101; 103; 105; 114; 117; 120; 163; 166; 171; 172; 277; 278; 300; 325; 338; 354; 397; 398; 401; 403; 407; 419; 421; 424; 480; 482; 511; 512; 518; 527; 531; 539; 569; 570; 571; 591; 596; 597; 598; 614; 619; 629; 658; 662; 668; 689; 690; 691; 693; 694; 719; 721; 722; 789; 842; 871; 872; 921; 949; 958; 1032; 1033; 1159; 1162; 1166; 1169; 1174; 1185; 1214; 1218; 1220; 1229; 1237; 1238; 1240; 1242; 1253; 1257; 1258; 1259; 1270; 1307; 1308; 1346; 1348; 1398; 1421; 1432; 1440; 1494; 1495; 1522; 1523; 1551; 1561; 1588; 1624; 1632; 1654; 1668; 1674; 1701; 1724; 1744; 1767; 1786; 1809; 1811; 1841; 1853; 1859; 1951; 1986; 2001; 2003; 2007; 2009; 2010; 2011; 2085; 2106; 2107; 2110; 2111; 2112; 2114; 2115; 2144; 2148; 2158; 2185; 2249; 2250; 2251; 2252; 2253; 2260; 2263; 2266; 2269; 2281; 2307; 2310; 2320; 2333; 2349; 2350; 2400; 2421; 2442; 2462; 2519; 2594; 2596; 2599; 2604; 2619; 2620; 2621; 2622; 2679; 2703; 2813; 2835; 2838; 2869; 2873; 2887; 2888; 2889; 2891; 2896; 2900; 2979; 3005; 3053; 3088; 3106; 3157; 3160; 3185; 3186; 3190; 3193; 3200; 3213; 3218; 3266; 3276; 3278; 3296; 3304; 3340; 3376; 3430; 3506; 3508; 3520; 3525; 3527; 3531; 3565; 3566; 3567; 3573; 3574; 3575; 3624; 3625; 3626; 3672; 3685; 3782; 3814; 3816; 3824; 3826; 3828; 3842; 3843; 3844; 3845; 3846; 3847; 3848; 3897; 3912; 3933; 3960; 3987; 3993; 4065; 4172; 4182; 4183; 4192; 4199; 4233; 4257; 4281; 4370; 4381; 4419; 4425; 4428; 4429; 4468; 4480; 4489; 4502; 4507; 4553; 4574; 4575; 4587; 4622; 4660; 4665; 4700; 4711; 4712; 4721; 4722; 4736; 4857; 4872; 4900; 4961; 5019; 5027; 5049; 5107; 5123; 5141; 5161; 5162; 5176; 5183; 5184; 5185; 5268; 5272; 5273; 5330; 5331; 5334; 5343; 5375; 5391; 5417; 5470; 5513; 5529 (see Table 1).

This combination permits correctly classifying 95.8% of the samples.

2.36. Identification of a Predictive Panel of 160 Markers (PANEL 34)

The inventors have demonstrated a combination of 160 markers, linked to an SVM algorithm, based on the sequences SEQ ID Nos: 26; 58; 75; 103; 105; 120; 166; 171; 172; 278; 325; 354; 397; 398; 419; 421; 424; 482; 518; 527; 539; 570; 571; 591; 597; 598; 619; 629; 658; 662; 689; 721; 872; 1033; 1159; 1162; 1166; 1174; 1218; 1229; 1237; 1238; 1240; 1242; 1258; 1259; 1270; 1307; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2144; 2185; 2249; 2251; 2263; 2269; 2307; 2310; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3213; 3304; 3376; 3430; 3508; 3527; 3531; 3565; 3567; 3575; 3625; 3672; 3685; 3824; 3842; 3846; 3847; 3848; 3897; 3960; 3993; 4172; 4182; 4192; 4257; 4281; 4419; 4425; 4428; 4429; 4468; 4507; 4553; 4660; 4722; 4872; 4900; 4961; 5019; 5027; 5107; 5141; 5176; 5183; 5184; 5268; 5272; 5334; 5343; 5391; 5417 (see Table 1).

This combination permits correctly classifying 95.6% of the samples.

2.37. Identification of a Predictive Panel of 150 Markers (Panel 35)

The inventors have demonstrated a combination of 150 markers, linked to an SVM algorithm, based on the sequences SEQ ID Nos: 26; 58; 75; 103; 105; 120; 166; 171; 172; 278; 325; 354; 397; 398; 419; 421; 482; 518; 527; 539; 570; 571; 591; 597; 598; 619; 629; 658; 662; 689; 721; 872; 1033; 1159; 1162; 1174; 1218; 1229; 1237; 1238; 1240; 1258; 1259; 1270; 1307; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2249; 2251; 2263; 2269; 2307; 2310; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3304; 3376; 3430; 3508; 3527; 3531; 3565; 3567; 3575; 3672; 3685; 3824; 3842; 3846; 3847; 3848; 3897; 3960; 3993; 4172; 4182; 4192; 4257; 4419; 4425; 4428; 4429; 4468; 4507; 4553; 4660; 4722; 4872; 4961; 5019; 5027; 5107; 5176; 5183; 5184; 5268; 5272; 5334; 5343; 5391; 5417 (see Table 1).

This combination permits correctly classifying 95.6% of the samples.

2.38. Identification of a Predictive Panel of 170 Markers (PANEL 36)

The inventors have demonstrated a combination of 170 markers, linked to an SVM algorithm, based on the sequences SEQ ID Nos: 26; 58; 75; 103; 105; 120; 166; 171; 172; 278; 325; 354; 397; 398; 419; 421; 424; 482; 512; 518; 527; 539; 570; 571; 591; 597; 598; 619; 629; 658; 662; 689; 694; 721; 872; 1033; 1159; 1162; 1166; 1174; 1218; 1229; 1237; 1238; 1240; 1242; 1258; 1259; 1270; 1307; 1308; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2144; 2185; 2249; 2251; 2253; 2263; 2269; 2307; 2310; 2320; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3213; 3266; 3304; 3376; 3430; 3508; 3525; 3527; 3531; 3565; 3567; 3575; 3625; 3672; 3685; 3824; 3828; 3842; 3846; 3847; 3848; 3897; 3960; 3993; 4172; 4182; 4192; 4233; 4257; 4281; 4381; 4419; 4425; 4428; 4429; 4468; 4507; 4553; 4660; 4722; 4872; 4900; 4961; 5019; 5027; 5107; 5141; 5176; 5183; 5184; 5268; 5272; 5334; 5343; 5391; 5417 (see Table 1).

This combination permits correctly classifying 95.6% of the samples.

2.39. Identification of a Predictive Panel of 180 Markers (PANEL 37)

The inventors have demonstrated a combination of 180 markers, linked to an SVM algorithm, based on the sequences SEQ ID Nos: 26; 58; 75; 103; 105; 120; 166; 171; 172; 278; 300; 325; 354; 397; 398; 419; 421; 424; 482; 512; 518; 527; 539; 569; 570; 571; 591; 596; 597; 598; 619; 629; 658; 662; 689; 694; 721; 872; 949; 1033; 1159; 1162; 1166; 1174; 1218; 1229; 1237; 1238; 1240; 1242; 1258; 1259; 1270; 1307; 1308; 1346; 1348; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2144; 2185; 2249; 2251; 2253; 2263; 2269; 2307; 2310; 2320; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3106; 3160; 3185; 3186; 3190; 3193; 3200; 3213; 3266; 3304; 3340; 3376;

3430; 3508; 3525; 3527; 3531; 3565; 3567; 3575; 3625; 3672; 3685; 3814; 3824; 3828; 3842; 3846; 3847; 3848; 3897; 3960; 3993; 4172; 4182; 4192; 4233; 4257; 4281; 4381; 4419; 4425; 4428; 4429; 4468; 4507; 4553; 4622; 4660; 4722; 4736; 4872; 4900; 4961; 5019; 5027; 5107; 5141; 5176; 5183; 5184; 5268; 5272; 5334; 5343; 5391; 5417 (see Table 1).

This combination permits correctly classifying 95.6% of the samples.

2.40. Identification of a Predictive Panel of 190 Markers (PANEL 38)

The inventors have demonstrated a combination of 190 markers, linked to an SVM algorithm, based on the sequences SEQ ID Nos: 26; 52; 58; 75; 103; 105; 120; 163; 166; 171; 172; 277; 278; 300; 325; 354; 397; 398; 419; 421; 424; 482; 512; 518; 527; 539; 569; 570; 571; 591; 596; 597; 598; 614; 619; 629; 658; 662; 689; 694; 719; 721; 872; 949; 1033; 1159; 1162; 1166; 1174; 1218; 1229; 1237; 1238; 1240; 1242; 1258; 1259; 1270; 1307; 1308; 1346; 1348; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2144; 2185; 2249; 2251; 2253; 2263; 2269; 2307; 2310; 2320; 2349; 2350; 2421; 2462; 2519; 2594; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3266; 3304; 3340; 3376; 3430; 3508; 3525; 3527; 3531; 3565; 3567; 3575; 3625; 3672; 3685; 3814; 3824; 3828; 3842; 3846; 3847; 3848; 3897; 3960; 3993; 4172; 4182; 4192; 4233; 4257; 4281; 4381; 4419; 4425; 4428; 4429; 4468; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5391; 5417 (see Table 1).

This combination permits correctly classifying 95.6% of the samples.

2.41. Identification of a Predictive Panel of 150 Markers (PANEL 39)

The inventors have demonstrated a combination of 150 markers, linked to an SVM algorithm, based on the sequences SEQ ID Nos: 26; 58; 75; 103; 105; 120; 166; 171; 172; 278; 325; 354; 397; 398; 419; 421; 482; 518; 527; 539; 570; 571; 591; 597; 598; 619; 629; 658; 662; 689; 721; 872; 1033; 1159; 1162; 1174; 1218; 1229; 1237; 1238; 1240; 1258; 1259; 1270; 1307; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2249; 2251; 2263; 2269; 2307; 2310; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3304; 3376; 3430; 3508; 3527; 3531; 3565; 3567; 3575; 3672; 3685; 3824; 3842; 3846; 3847; 3848; 3897; 3960; 3993; 4172; 4182; 4192; 4257; 4419; 4425; 4428; 4429; 4468; 4507; 4553; 4660; 4722; 4872; 4961; 5019; 5027; 5107; 5176; 5183; 5184; 5268; 5272; 5334; 5343; 5391; 5417 (see Table 1).

This combination permits correctly classifying 95.6% of the samples.

2.42. Identification of a Predictive Panel of 150 Markers (PANEL 40)

The inventors have demonstrated a combination of 150 markers, linked to an SVM algorithm, based on the sequences SEQ ID Nos: 26; 58; 75; 103; 105; 120; 166; 171; 172; 278; 325; 354; 397; 398; 419; 421; 482; 518; 527; 539; 570; 571; 591; 597; 598; 619; 629; 658; 662; 689; 721; 872; 1033; 1159; 1162; 1174; 1218; 1229; 1237; 1238; 1240; 1258; 1259; 1270; 1307; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2249; 2251; 2263; 2269; 2307; 2310; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3304; 3376; 3430; 3508; 3527; 3531; 3565; 3567; 3575; 3672; 3685; 3824; 3842; 3846; 3847; 3848; 3897; 3960; 3993; 4172; 4182; 4192; 4257; 4419; 4425; 4428; 4429; 4468; 4507; 4553; 4660; 4722; 4872; 4961; 5019; 5027; 5107; 5176; 5183; 5184; 5268; 5272; 5334; 5343; 5391; 5417 (see Table 1).

This combination permits correctly classifying 95.6% of the samples.

2.43. Identification of a Predictive Panel of 210 Markers (PANEL 41)

The inventors have demonstrated a combination of 210 markers, linked to an SVM algorithm, based on the sequences SEQ ID Nos: 26; 52; 58; 75; 103; 105; 114; 120; 163; 166; 171; 172; 277; 278; 300; 325; 354; 397; 398; 407; 419; 421; 424; 482; 512; 518; 527; 539; 569; 570; 571; 591; 596; 597; 598; 614; 619; 629; 658; 662; 689; 694; 719; 721; 872; 949; 1033; 1159; 1162; 1166; 1169; 1174; 1214; 1218; 1229; 1237; 1238; 1240; 1242; 1258; 1259; 1270; 1307; 1308; 1346; 1348; 1432; 1440; 1494; 1495; 1522; 1523; 1551; 1588; 1632; 1654; 1668; 1674; 1724; 1744; 1786; 1841; 1853; 1859; 1951; 1986; 2001; 2007; 2009; 2010; 2110; 2115; 2144; 2185; 2249; 2250; 2251; 2253; 2260; 2263; 2269; 2281; 2307; 2310; 2320; 2349; 2350; 2421; 2462; 2519; 2594; 2604; 2619; 2620; 2621; 2622; 2813; 2835; 2838; 2869; 2873; 2887; 2888; 2889; 2896; 2900; 2979; 3005; 3053; 3088; 3106; 3157; 3160; 3185; 3186; 3190; 3193; 3200; 3213; 3218; 3266; 3278; 3304; 3340; 3376; 3430; 3506; 3508; 3525; 3527; 3531; 3565; 3567; 3575; 3625; 3626; 3672; 3685; 3782; 3814; 3824; 3828; 3842; 3846; 3847; 3848; 3897; 3960; 3993; 4172; 4182; 4192; 4233; 4257; 4281; 4381; 4419; 4425; 4428; 4429; 4468; 4480; 4489; 4507; 4553; 4574; 4587; 4622; 4660; 4722; 4736; 4872; 4900; 4961; 5019; 5027; 5107; 5141; 5176; 5183; 5184; 5268; 5272; 5331; 5334; 5343; 5375; 5391; 5417; 5529 (see Table 1).

This combination permits correctly classifying 95.6% of the samples.

2.44. Identification of a Predictive Panel of 170 Markers (PANEL 42)

The inventors have demonstrated a combination of 170 markers, linked to an SVM algorithm, based on the sequences SEQ ID Nos: 26; 58; 75; 103; 105; 120; 166; 171; 172; 278; 325; 354; 397; 398; 419; 421; 424; 482; 512; 518; 527; 539; 570; 571; 591; 597; 598; 619; 629; 658; 662; 689; 694; 721; 872; 1033; 1159; 1162; 1166; 1174; 1218; 1229; 1237; 1238; 1240; 1242; 1258; 1259; 1270; 1307; 1308; 1346; 1432; 1440; 1495; 1522; 1523; 1588; 1632; 1654; 1668; 1674; 1744; 1786; 1841; 1853; 1859; 1951; 1986; 2001; 2007; 2009; 2010; 2110; 2115; 2144; 2185; 2249; 2251; 2253; 2263; 2269; 2307; 2310; 2320; 2349; 2350; 2421; 2462; 2519; 2594; 2619; 2620; 2621; 2622; 2813; 2835; 2838; 2873; 2887; 2888; 2889; 2896; 2900; 2979; 3005; 3053; 3088; 3160; 3185; 3186; 3190; 3193; 3200; 3213; 3266; 3304; 3376; 3430; 3508; 3525; 3527; 3531; 3565; 3567; 3575; 3625; 3672; 3685; 3824; 3828; 3842; 3846; 3847; 3848; 3897; 3960; 3993; 4172; 4182; 4192; 4233; 4257; 4281; 4381; 4419; 4425; 4428; 4429; 4468; 4507; 4553; 4660; 4722; 4872; 4900; 4961; 5019; 5027; 5107; 5141; 5176; 5183; 5184; 5268; 5272; 5334; 5343; 5391; 5417 (see Table 1).

This combination permits correctly classifying 95.4% of the samples.

2.45. Identification of a Predictive Panel of 60 Markers (PANEL 43)

The inventors have demonstrated a combination of 60 markers, linked to an SVM algorithm, based on the sequences SEQ ID Nos: 26; 58; 105; 120; 166; 325; 354; 397; 398; 570; 571; 598; 619; 629; 721; 1033; 1218; 1229; 1237; 1238; 1258; 1259; 1270; 1346; 1432; 1440; 1495; 1588; 1632; 1668; 1853; 1859; 2009; 2269; 2594; 2620; 2622; 2838; 2887; 3200; 3304; 3430; 3508; 3527; 3575; 3960; 3993; 4192; 4419; 4428; 4429; 4660; 4722; 4961; 5107; 5176; 5183; 5184; 5391; 5417 (see Table 1).

This combination permits correctly classifying 95.2% of the samples.

2.46. Identification of a Predictive Panel of 190 Markers (PANEL 44)

The inventors have demonstrated a combination of 190 markers, linked to an SVM algorithm, based on the sequences SEQ ID Nos: 1; 6; 28; 73; 321; 323; 343; 350; 352; 397; 417; 418; 513; 538; 542; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2132; 2133; 2143; 2144; 2209; 2284; 2305; 2365; 2372; 2375; 2378; 2380; 2382; 2390; 2399; 2406; 2411; 2458; 2459; 2462; 2469; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3767; 3782; 3807; 3810; 3811; 3822; 3857; 3862; 3904; 3920; 3936; 3940; 3958; 4019; 4076; 4093; 4094; 4096; 4130; 4295; 4297; 4345; 4350; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5017; 5067; 5080; 5144; 5198; 5221; 5238; 5380; 5383; 5450; 5529; 5532; 5555 (see Table 1).

This combination permits correctly classifying 92.8% of the samples.

2.47. Identification of a Predictive Panel of 170 Markers (PANEL 45)

The inventors have demonstrated a combination of 170 markers, linked to an SVM algorithm, based on the sequences SEQ ID Nos: 1; 28; 73; 321; 323; 350; 397; 417; 418; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1950; 1951; 1952; 1953; 1984; 1994; 1995; 2023; 2038; 2117; 2126; 2127; 2128; 2129; 2130; 2133; 2144; 2284; 2305; 2365; 2372; 2375; 2378; 2380; 2382; 2399; 2406; 2411; 2458; 2459; 2462; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3596; 3600; 3690; 3782; 3807; 3810; 3811; 3822; 3857; 3862; 3904; 3920; 3940; 3958; 4019; 4076; 4093; 4094; 4096; 4130; 4295; 4297; 4345; 4351; 4428; 4434; 4442; 4468; 4493; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 5067; 5080; 5144; 5198; 5221; 5238; 5380; 5383; 5450; 5532; 5555 (see Table 1).

This combination permits correctly classifying 92.5% of the samples.

2.48. Identification of a Predictive Panel of 180 Markers (PANEL 46)

The inventors have demonstrated a combination of 180 markers, linked to an SVM algorithm, based on the sequences SEQ ID Nos: 1; 28; 73; 321; 323; 350; 352; 397; 417; 418; 513; 538; 612; 720; 788; 852; 990; 991; 1152; 1154; 1169; 1212; 1237; 1239; 1242; 1326; 1489; 1490; 1641; 1683; 1694; 1711; 1723; 1731; 1741; 1744; 1747; 1749; 1789; 1800; 1831; 1833; 1834; 1837; 1859; 1950; 1951; 1952; 1953; 1984; 1994; 1995; 2023; 2038; 2117; 2126; 2127; 2128; 2129; 2130; 2133; 2143; 2144; 2284; 2305; 2365; 2372; 2375; 2378; 2380; 2382; 2390; 2399; 2406; 2411; 2458; 2459; 2462; 2528; 2529; 2532; 2533; 2534; 2538; 2542; 2543; 2556; 2563; 2564; 2652; 2679; 2703; 2708; 2709; 2725; 2727; 2732; 2740; 2887; 2888; 2900; 2941; 2942; 2943; 2944; 3043; 3057; 3092; 3286; 3384; 3387; 3574; 3596; 3600; 3673; 3690; 3782; 3807; 3810; 3811; 3822; 3857; 3862; 3904; 3920; 3936; 3940; 3958; 4019; 4076; 4093; 4094; 4096; 4130; 4295; 4297; 4345; 4351; 4428; 4434; 4442; 4468; 4493; 4497; 4510; 4515; 4546; 4596; 4603; 4706; 4736; 4744; 4804; 4860; 4885; 4888; 4889; 4890; 4891; 4892; 4897; 4898; 4899; 4918; 4955; 4975; 4976; 4978; 4982; 5067; 5080; 5144; 5198; 5221; 5238; 5380; 5383; 5450; 5532; 5555 (see Table 1).

This combination permits correctly classifying 92.5% of the samples.

2.49. Identification of a Predictive Panel of 35 Markers (PANEL 55)

The inventors have demonstrated a combination of 35 markers, linked to an LDA algorithm, based on the sequences SEQ ID Nos: 60; 1154; 1169; 1242; 1641; 1699; 1744; 1834; 1837; 2023; 2078; 2126; 2127; 2128; 2130; 2142; 2145; 2328; 2375; 2411; 2458; 2529; 2533; 2543; 2725; 2727; 2943; 2944; 3044; 3057; 3822; 4351; 4523; 5233; 5238 (see Table 1).

The performances obtained are: a sensitivity of 100% and a specificity of 80%.

2.50. Identification of a Predictive Panel of 35 Markers (PANEL 56)

The inventors have demonstrated a combination of 35 markers, linked to an LDA algorithm, based on the sequences SEQ ID Nos: 60; 1152; 1154; 1169; 1242; 1744; 1834; 2023; 2038; 2078; 2126; 2127; 2128; 2142; 2145; 2300; 2328; 2380; 2411; 2458; 2528; 2529; 2533; 2543; 2725; 2727; 2943; 2944; 3044; 3057; 3904; 4351; 4975; 5233; 5238 (see Table 1).

The performances obtained are: a sensitivity of 100% and a specificity of 80%.

2.51. Identification of a Predictive Panel of 16 Markers (PANEL 57)

The inventors have demonstrated a combination of 16 markers, linked to an LDA algorithm, based on the sequences SEQ ID Nos: 60; 1169; 1744; 1834; 2078; 2127; 2145; 2529; 2533; 2543; 2725; 2727; 2943; 2944; 3057; 5238 (see Table 1).

The performances obtained are: a sensitivity of 100% and a specificity of 80%.

2.52. Identification of a Predictive Panel of 13 Markers (PANEL 58)

The inventors have demonstrated a combination of 13 markers, linked to an LDA algorithm, based on the sequences SEQ ID Nos: 1169; 1834; 2038; 2078; 2127; 2145; 2533; 2543; 2725; 2727; 2943; 2944; 5238 (see Table 1).

The performances obtained are: a sensitivity of 100% and a specificity of 80%.

2.53. Identification of a Predictive Panel of 28 Markers (PANEL 59)

The inventors have demonstrated a combination of 28 markers, linked to an LDA algorithm, based on the sequences SEQ ID Nos: 26; 58; 527; 529; 629; 1169; 1259; 1270; 1588; 1632; 1668; 1841; 1854; 1912; 2622; 2623; 3187; 3527; 3625; 3672; 3994; 4428; 4429; 4961; 4988; 5087; 5107; 5113 (see Table 1).

The performances obtained are: a sensitivity of 100% and a specificity of 85%.

2.54. Identification of a Predictive Panel of 14 Markers (PANEL 60)

The inventors have demonstrated a combination of 14 markers, linked to an LDA algorithm, based on the sequences SEQ ID Nos: 58; 529; 1169; 1259; 1270; 1588; 1632; 1668; 1841; 1854; 3672; 4429; 5087; 5107 (see Table 1).

The performances obtained are: a sensitivity of 100% and a specificity of 80%.

These last signatures confirm that analysis of the expression of 13, 14 or 16 markers can be a good tool to discriminate patients with Alzheimer's disease. The use of the restricted gene panel can be particularly suited to obtain a diagnosis and prognosis tool In fact, analysis of the expression of around ten markers does not require fabricating a high-density DNA chip, and can be directly implemented by other nucleic acid detection techniques, such as PCR, or by a low-density chip, which could provide a significant economic benefit and a simplified implementation.

EXAMPLE 3

Demonstrating Expression Profiles for Diagnosing Alzheimer's Disease from Blood Samples by Relative Measurements of Probe Pairs Another possible approach to searching for expression biomarkers comprises considering, instead of the absolute expression of one or more probe sets, rather the relative expression of different intra- or inter-gene probe sets. A gene produces several transcripts that participate in the complexity of its expression and its transcriptome. The probe sets on the GWSA microarray cover the transcriptome of each gene at strategic positions (specific splice variants and the exon-intron structure of the gene). Any gene can thus give rise to a probe set that can be up-regulated in a group of AD patients, while a second probe set derived from the same gene could be down-regulated. The relative expression of these two probe sets could then represent a statistically more significant diagnostic power than the individual expression of each probe set. A simplified analysis of the relative expression comprises identifying the pairs of probe sets for which the relative expression is reversed between the AD patient group and the control group. Thus, a score comprised between +1 and −1 can be associated with any pair of probe sets (x, y) based on the frequency of AD patients and controls for which x>y. For example, if x>y in 100% of AD patients and 0% of control individuals, then the score is 1−0=1. For example, if x>y in 80% of AD patients and 20% of control individuals, then the score is 0.8−0.2=0.6.

This analysis was done from all the genes present on the GWSA chip, by comparing all the probe sets within a same gene (filtered above the expression threshold of 3.8 (log 2)), from a set of 150 samples (80 AD and 70 controls) This analysis was done first from normalized expression values. More than 90% of the pairs have a score whose absolute value is less than 0.2, indicating an equilibrated and equivalent distribution of pairs (x, y) for which x>y in the AD group and the control group. The highest score obtained is 0.75 and concerns the pair SEQ ID NO: 2677 and 2678, coming from the ATPase, Na+/K+ transporting, alpha 1 gene (ATP1A1, Gene ID: 476). 2007 pairs of probe sets have a score whose absolute value is greater than or equal to 0.5. This is the TSP N group (scores in column I of Table 2). Such scores are significant, as the following analysis performed on the three genes shows: Presenilin 1 (PSEN1), CD45 (PTPRC) and Sortilin-1 (SORL1). The best scores obtained for these three genes are respectively: 0.55; 0.57 and 0.69. This analysis was repeated on 1000 cases by creating two random groups of 80 and 70 individuals for each case out of the 150 individuals. The best scores obtained randomly are then 0.40, 0.39 and 0.45, all three lower than the scores of 0.55; 0.57 and 0.69 obtained from the AD and control group. These results demonstrate that the best scores associated with the probe set pairs of these three genes are statistically significant for the two groups compared. The definition of a score threshold at 0.5 is therefore significant. This TSP N group is represented by the probe pairs of the following sets (a pair being represented by x_y):

SEQ ID NO : 1_3; 1_5; 1_10; 1_11; 1_12; 1_13; 1_14; 2_3; 3_4; 4_10; 7_9; 8_9; 28_29; 29_31; 33_34; 33_35; 33_36; 33_37; 44_49; 53_54; 56_57; 68_72; 69_71; 69_73; 69_76; 69_77; 69_78; 69_81; 69_82; 69_83; 70_83; 74_79; 74_85; 92_93; 95_96; 95_97; 106_107; 1_11_112; 122_124; 123_124; 129_130; 133_134; 135_139; 135_142; 135_144; 135_145; 135_146; 136_140; 136_141; 136_148; 136_149; 151_152; 154_155; 168_169; 168_170; 176_177; 182_183; 188_189; 192_193; 194_201; 194_207; 195_199; 195_203; 195_210; 196_212; 197_210; 198_202; 200_205; 202_204; 204_211; 205_208; 205_209; 206_212; 217_222; 218_220; 219_220; 220_221; 223_224; 224_225; 224_227; 224_228; 224_229; 224_230; 224_232; 224_233; 224_235; 224_236; 224_237; 224_238; 224_239; 224_240; 224_242; 224_243; 224_244; 224_246; 224_247; 224_248; 224_249; 224_250; 224_251; 224_252; 224_253; 224_254; 224_255; 224_257; 224_258; 224_259; 231_224; 264_268; 265_272; 266_269; 267_269; 269_273; 270_272; 270_274; 270_275; 270_276; 280_281; 282_283; 286_288; 287_288; 289_290; 291_292; 296_297; 298_299; 302_303; 303_304; 307_309; 314_315; 316_317; 318_319; 320_323; 326_327; 328_331; 329_332; 330_331; 331_333; 331_334; 331_335; 331_336; 344_346; 358_361; 363_364; 367_368; 367_369; 373_375; 380_381; 385_386; 386_391; 386_392; 387_389; 388_390; 393_395; 411_412; 414_418; 415_418; 429_430; 433_434; 434_435; 434_438; 436_437; 439_440; 463_464; 477_478; 477_479; 481_483; 484_485; 486_487; 486_488; 486_489; 486_490; 486_494; 486_495; 486_496; 486_497; 486_499; 491_493; 504_505; 507_508; 533_534; 544_548; 545_547; 546_552; 547_550; 547_553; 547_554; 549_551; 549_555; 557_558; 559_561; 560_566; 562_564; 573_574; 575_578; 576_578; 577_578; 579_580; 584_585; 586_587; 588_589; 610_611; 621_629; 622_629; 623_629; 624_629; 625_629; 626_629; 627_629; 628_629; 629_630; 629_632; 639_640; 642_643; 644_645; 649_651; 652_653; 670_672; 671_672; 674_675; 680_681; 682_683; 684_685; 700_702; 701_702; 703_704; 714_715; 717_718; 727_728; 733_735; 734_736; 740_743; 741_743; 742_746; 742_748; 743_745; 750_753; 755_756; 761_763; 761_764; 765_766; 765_767; 771_772; 771_773; 772_774; 773_774; 779_780; 791_795; 791_799; 791_801; 791_803; 791_814;

792_811; 793_807; 793_811; 794_811; 796_824; 797_809; 797_811; 804_811; 805_811; 806_825; 808_816; 808_823; 809_813; 810_816; 810_823; 811_813; 811_815; 811_818; 811_819; 811_820; 811_821; 811_822; 812_821; 827_829; 827_831; 828_830; 832_835; 833_837; 834_836; 835_838; 835_841; 836_841; 838_840; 847_849; 848_851; 849_850; 852_854; 852_855; 856_863; 856_866; 858_860; 862_865; 869_870; 873_882; 874_878; 874_882; 875_882; 876_882; 877_882; 879_882; 882_885; 883_884; 895_899; 895_900; 897_898; 898_904; 899_901; 907_909; 908_911; 919_920; 929_930; 929_931; 937_938; 941_942; 943_945; 943_946; 943_947; 944_947; 955_959; 960_961; 961_962; 961_963; 961_964; 961_965; 961_966; 961_968; 961_969; 970_971; 970_972; 974_975; 993_1011; 994_996; 994_1013; 995_997; 995_1001; 995_1002; 995_1003; 996_999; 998_1004; 998_1009; 998_1012; 1000_1009; 1005_1011; 1006_1011; 1007_1011; 1008_1011; 1009_1010; 1018_1021; 1022_1025; 1023_1024; 1024_1026; 1027_1028; 1034_1037; 1035_1036; 1038_1039; 1047_1048; 1053_1055; 1056_1059; 1056_1063; 1057_1060; 1058_1062; 1059_1061; 1064_1072; 1065_1067; 1066_1067; 1067_1068; 1067_1069; 1067_1071; 1068_1072; 1073_1074; 1081_1083; 1081_1084; 1081_1085; 1082_1086; 1087_1088; 1088_1089; 1088_1090; 1088_1091; 1088_1092; 1093_1094; 1097_1099; 1098_1101; 1098_1105; 1102_1117; 1103_1110; 1104_1114; 1107_1111; 1110_1118; 1110_1119; 1123_1133; 1124_1133; 1125_1126; 1125_1127; 1125_1128; 1125_1129; 1125_1130; 1125_1131; 1125_1132; 1134_1139; 1135_1138; 1136_1137; 1141_1144; 1174_1176; 1180_1183; 1181_1182; 1189_1190; 1189_1191; 1193_1194; 1193_1195; 1196_1197; 1196_1198; 1201_1202; 1208_1209; 1208_1210; 1208_1211; 1212_1213; 1219_1239; 1221_1237; 1222_1239; 1223_1242; 1224_1239; 1226_1244; 1226_1261; 1229_1231; 1229_1233; 1229_1247; 1231_1237; 1232_1239; 1233_1260; 1234_1242; 1234_1258; 1234_1259; 1236_1242; 1237_1243; 1237_1245; 1237_1249; 1237_1251; 1237_1263; 1237_1265; 1237_1267; 1238_1245; 1238_1249; 1238_1251; 1239_1244; 1239_1262; 1239_1266; 1239_1269; 1241_1256; 1242_1248; 1242_1250; 1242_1252; 1242_1255; 1245_1254; 1247_1253; 1247_1254; 1248_1258; 1248_1259; 1249_1254; 1271_1273; 1272_1274; 1275_1276; 1279_1280; 1281_1285; 1282_1284; 1283_1284; 1289_1292; 1290_1291; 1291_1293; 1295_1296; 1295_1297; 1299_1306; 1300_1303; 1301_1302; 1310_1311; 1310_1319; 1310_1320; 1310_1325; 1312_1321; 1312_1324; 1313_1326; 1314_1324; 1315_1328; 1317_1326; 1318_1319; 1323_1329; 1323_1330; 1326_1331; 1334_1336; 1335_1336; 1339_1340; 1341_1342; 1344_1345; 1350_1352; 1351_1353; 1359_1360; 1363_1364; 1367_1382; 1367_1383; 1368_1372; 1370_1385; 1371_1374; 1373_1389; 1375_1383; 1376_1388; 1380_1383; 1382_1392; 1383_1392; 1384_1390; 1384_1393; 1386_1387; 1386_1391; 1399_1402; 1400_1402; 1402_1403; 1402_1405; 1402_1407; 1402_1409; 1408_1412; 1418_1419; 1423_1427; 1424_1427; 1429_1430; 1429_1431; 1433_1435; 1434_1435; 1435_1438; 1436_1437; 1441_1442; 1443_1444; 1444_1446; 1444_1447; 1448_1450; 1448_1452; 1448_1453; 1448_1456; 1448_1457; 1448_1458; 1448_1459; 1448_1460; 1448_1461; 1448_1462; 1448_1463; 1448_1465; 1451_1471; 1453_1470; 1454_1467; 1466_1469; 1475_1476; 1476_1481; 1476_1482; 1477_1478; 1478_1479; 1478_1483; 1485_1489; 1486_1490; 1488_1490; 1488_1499; 1490_1492; 1490_1497; 1490_1500; 1501_1502; 1501_1503; 1501_1504; 1507_1508; 1511_1514; 1511_1519; 1536_1539; 1537_1539; 1538_1539; 1539_1540; 1539_1542; 1539_1544; 1541_1543; 1543_1545; 1546_1548; 1546_1550; 1547_1549; 1553_1554; 1553_1555; 1556_1558; 1557_1558; 1564_1565; 1567_1572; 1568_1569; 1570_1571; 1572_1573; 1572_1574; 1586_1587; 1593_1595; 1594_1596; 1602_1601; 1603_1605; 1604_1606; 1607_1608; 1610_1615; 1611_1614; 1612_1615; 1613_1614; 1620_1625; 1625_1626; 1628_1631; 1637_1638; 1641_1642; 1641_1644; 1641_1645; 1641_1646; 1655_1657; 1658_1659; 1658_1660; 1658_1661; 1658_1662; 1658_1663; 1658_1664; 1658_1665; 1658_1666; 1676_1677; 1678_1679; 1680_1681; 1682_1685; 1683_1684; 1683_1686; 1687_1688; 1694_1698; 1703_1704; 1704_1707; 1706_1708; 1711_1712; 1715_1716; 1726_1727; 1727_1728; 1732_1738; 1733_1745; 1735_1751; 1736_1745; 1738_1745; 1739_1745; 1745_1746; 1745_1750; 1749_1752; 1754_1755; 1757_1758; 1760_1761; 1768_1769; 1777_1781; 1778_1781; 1781_1783; 1795_1797; 1796_1797; 1803_1804; 1817_1818; 1817_1819; 1820_1821; 1835_1837; 1842_1843; 1848_1850; 1848_1852; 1864_1866; 1865_1866; 1866_1867; 1866_1868; 1866_1869; 1866_1871; 1866_1872; 1866_1873; 1866_1874; 1866_1875; 1866_1877; 1866_1878; 1866_1879; 1866_1880; 1866_1881; 1866_1882; 1866_1883; 1866_1884; 1866_1885; 1866_1886; 1866_1887; 1866_1888; 1866_1889; 1866_1891; 1866_1892; 1866_1893; 1866_1894; 1866_1895; 1866_1896; 1866_1897; 1866_1898; 1866_1899; 1866_1900; 1866_1901; 1866_1902; 1866_1903; 1866_1904; 1866_1905; 1866_1906; 1866_1907; 1866_1908; 1866_1909; 1870_1866; 1921_1922; 1921_1923; 1921_1924; 1922_1927; 1922_1928; 1922_1929; 1922_1930; 1925_1931; 1925_1932; 1936_1937; 1939_1941; 1939_1943; 1939_1944; 1939_1945; 1949_1954; 1957_1958; 1962_1963; 1965_1967; 1974_1975; 1988_1992; 1991_1993; 1997_1998; 2004_2006; 2013_2016; 2014_2016; 2015_2016; 2018_2019; 2026_2027; 2028_2029; 2029_2031; 2029_2034; 2030_2033; 2035_2036; 2043_2044; 2046_2048; 2051_2058; 2051_2059; 2052_2057; 2053_2059; 2055_2059; 2056_2059; 2065_2067; 2065_2079; 2066_2069; 2067_2076; 2068_2074; 2070_2078; 2071_2078; 2071_2082; 2072_2073; 2072_2081; 2073_2075; 2075_2081; 2076_2080; 2077_2083; 2077_2084; 2089_2090; 2101_2102; 2102_2105; 2103_2105; 2126_2131; 2138_2146; 2149_2152; 2150_2155; 2151_2154; 2151_2156; 2162_2163; 2169_2170; 2169_2171; 2169_2173; 2169_2174; 2178_2179; 2178_2181; 2183_2184; 2189_2191; 2191_2193; 2191_2194; 2191_2198; 2192_2197; 2192_2199; 2194_2196; 2196_2198; 2205_2206; 2208_2213; 2209_2210; 2211_2212; 2219_2226; 2220_2223; 2222_2226; 2223_2231; 2224_2226; 2225_2226; 2226_2227; 2226_2229; 2226_2230; 2226_2232; 2226_2233; 2226_2234; 2236_2237; 2236_2238; 2239_2240; 2244_2245; 2248_2262; 2251_2262; 2253_2262;

2259_2261; 2262_2265; 2273_2276; 2274_2276;
2275_2276; 2276_2277; 2282_2283; 2285_2297;
2286_2287; 2286_2292; 2286_2297; 2288_2299;
2289_2299; 2291_2299; 2293_2299; 2294_2298;
2295_2296; 2302_2303; 2334_2338; 2338_2339;
2342_2343; 2351_2355; 2351_2357; 2353_2356;
2363_2364; 2366_2385; 2370_2386; 2375_2388;
2403_2404; 2422_2424; 2424_2427; 2424_2428;
2425_2427; 2426_2428; 2429_2430; 2432_2433;
2432_2434; 2448_2449; 2452_2453; 2455_2458;
2458_2466; 2459_2463; 2462_2463; 2464_2467;
2464_2468; 2472_2473; 2477_2478; 2477_2479;
2480_2481; 2482_2483; 2484_2485; 2487_2488;
2491_2492; 2495_2500; 2496_2505; 2496_2507;
2497_2499; 2497_2504; 2497_2505; 2497_2506;
2497_2508; 2497_2510; 2497_2512; 2497_2516;
2498_2504; 2498_2505; 2498_2509; 2498_2510;
2498_2511; 2498_2513; 2498_2514; 2500_2508;
2501_2511; 2502_2509; 2502_2511; 2502_2513;
2503_2506; 2503_2508; 2522_2523; 2528_2535;
2529_2537; 2532_2535; 2540_2563; 2541_2570;
2541_2572; 2542_2547; 2542_2550; 2542_2567;
2542_2568; 2543_2567; 2544_2572; 2549_2544;
2549_2545; 2549_2561; 2549_2576; 2551_2575;
2552_2575; 2553_2557; 2554_2558; 2561_2572;
2561_2573; 2562_2571; 2563_2565; 2563_2566;
2563_2569; 2564_2567; 2564_2568; 2572_2574;
2580_2581; 2608_2609; 2614_2615; 2624_2631;
2625_2626; 2626_2629; 2627_2630; 2637_2639;
2640_2642; 2641_2642; 2644_2645; 2646_2647;
2649_2650; 2652_2653; 2652_2656; 2652_2657;
2654_2655; 2661_2670; 2662_2664; 2662_2671;
2663_2669; 2664_2673; 2665_2667; 2666_2669;
2668_2670; 2668_2671; 2670_2673; 2671_2672;
2677_2678; 2677_2682; 2677_2688; 2677_2689;
2677_2694; 2678_2686; 2678_2690; 2682_2685;
2682_2686; 2682_2690; 2683_2692; 2686_2688;
2686_2689; 2687_2688; 2688_2690; 2689_2690;
2693_2694; 2704_2705; 2706_2708; 2707_2711;
2708_2712; 2713_2714; 2716_2718; 2716_2726;
2718_2722; 2719_2727; 2720_2723; 2722_2723;
2730_2745; 2731_2732; 2732_2733; 2732_2734;
2732_2736; 2732_2737; 2732_2738; 2734_2744;
2746_2748; 2748_2750; 2748_2757; 2748_2758;
2748_2759; 2749_2751; 2751_2756; 2752_2755;
2753_2754; 2760_2761; 2767_2768; 2773_2774;
2777_2779; 2778_2779; 2778_2780; 2778_2781;
2784_2786; 2785_2786; 2792_2794; 2797_2810;
2798_2799; 2800_2807; 2800_2808; 2801_2810;
2802_2806; 2803_2805; 2812_2814; 2812_2815;
2819_2827; 2820_2822; 2821_2822; 2822_2829;
2826_2832; 2830_2832; 2833_2834; 2839_2840;
2840_2842; 2845_2847; 2848_2849; 2854_2857;
2854_2864; 2854_2867; 2855_2858; 2855_2859;
2855_2868; 2856_2861; 2860_2861; 2861_2865;
2861_2866; 2875_2876; 2875_2877; 2875_2881;
2875_2884; 2878_2880; 2878_2883; 2878_2885;
2880_2882; 2911_2912; 2918_2923; 2926_2927;
2928_2929; 2948_2949; 2952_2953; 2952_2954;
2955_2959; 2956_2961; 2962_2965; 2963_2964;
2967_2973; 2968_2971; 2969_2972; 2970_2972;
2975_2977; 2980_2981; 2983_2984; 2986_2987;
2988_2989; 2988_2990; 2988_2992; 3001_3003;
3001_3004; 3008_3009; 3010_3011; 3011_3013;
3012_3013; 3015_3023; 3016_3027; 3017_3018;
3017_3023; 3017_3025; 3017_3026; 3017_3029;
3018_3030; 3018_3032; 3020_3023; 3023_3022;
3023_3030; 3023_3031; 3023_3032; 3027_3034;
3047_3049; 3051_3052; 3054_3056; 3057_3058;
3062_3063; 3064_3065; 3071_3073; 3072_3073;
3077_3078; 3077_3084; 3078_3080; 3078_3082;
3079_3084; 3090_3092; 3091_3092; 3092_3093;
3092_3094; 3092_3095; 3092_3099; 3100_3101;
3111_3112; 3111_3114; 3111_3115; 3116_3117;
3119_3137; 3120_3122; 3121_3123; 3121_3144;
3122_3125; 3122_3131; 3122_3133; 3122_3138;
3122_3139; 3122_3146; 3122_3147; 3123_3135;
3123_3140; 3126_3128; 3126_3130; 3127_3144;
3129_3145; 3132_3149; 3136_3144; 3140_3144;
3141_3146; 3141_3147; 3151_3152; 3154_3155;
3162_3163; 3168_3169; 3168_3170; 3176_3181;
3177_3182; 3178_3180; 3180_3183; 3197_3198;
3198_3199; 3201_3202; 3203_3204; 3227_3230;
3228_3231; 3236_3238; 3236_3239; 3236_3240;
3237_3238; 3242_3248; 3243_3244; 3243_3245;
3243_3246; 3243_3247; 3247_3249; 3251_3254;
3251_3256; 3258_3259; 3261_3263; 3262_3265;
3269_3271; 3274_3275; 3283_3284; 3287_3293;
3288_3289; 3289_3292; 3290_3293; 3290_3294;
3299_3300; 3316_3318; 3317_3321; 3318_3319;
3328_3329; 3331_3332; 3333_3334; 3336_3337;
3339_3344; 3343_3348; 3351_3352; 3351_3353;
3354_3357; 3357_3364; 3359_3363; 3367_3368;
3368_3369; 3370_3371; 3382_3383; 3385_3396;
3387_3395; 3387_3396; 3388_3398; 3388_3399;
3388_3401; 3390_3391; 3390_3392; 3390_3400;
3391_3397; 3393_3396; 3394_3404; 3395_3404;
3395_3405; 3396_3403; 3396_3404; 3396_3405;
3397_3398; 3397_3399; 3406_3407; 3407_3408;
3414_3415; 3415_3416; 3418_3419; 3421_3422;
3423_3424; 3431_3436; 3432_3437; 3433_3441;
3434_3439; 3435_3436; 3438_3440; 3438_3441;
3444_3463; 3444_3471; 3445_3446; 3447_3454;
3447_3460; 3449_3473; 3451_3464; 3451_3467;
3451_3468; 3453_3467; 3454_3464; 3454_3470;
3455_3465; 3456_3465; 3456_3467; 3475_3477;
3475_3479; 3476_3477; 3477_3482; 3478_3481;
3483_3484; 3485_3486; 3487_3488; 3492_3493;
3493_3495; 3494_3496; 3498_3499; 3501_3503;
3501_3504; 3510_3511; 3511_3513; 3512_3513;
3513_3514; 3528_3529; 3543_3544; 3544_3545;
3546_3549; 3547_3548; 3554_3555; 3556_3557;
3560_3561; 3570_3571; 3584_3585; 3589_3591;
3591_3592; 3591_3593; 3591_3594; 3603_3604;
3605_3606; 3610_3611; 3610_3612; 3610_3614;
3610_3616; 3610_3618; 3610_3619; 3610_3621;
3611_3622; 3612_3613; 3613_3618; 3613_3620;
3617_3618; 3630_3635; 3631_3633; 3631_3643;
3632_3634; 3632_3637; 3632_3641; 3638_3642;
3644_3645; 3647_3648; 3651_3653; 3652_3653;
3653_3655; 3653_3656; 3653_3658; 3653_3659;
3653_3662; 3653_3664; 3653_3668; 3675_3676;
3677_3680; 3678_3695; 3679_3690; 3681_3682;
3682_3687; 3682_3693; 3682_3694; 3682_3697;
3683_3689; 3683_3691; 3683_3696; 3684_3693;
3700_3701; 3703_3704; 3710_3720; 3711_3719;
3712_3715; 3714_3718; 3722_3725; 3723_3724;
3724_3726; 3724_3727; 3724_3728; 3724_3729;
3730_3731; 3735_3736; 3737_3741; 3738_3741;
3739_3741; 3740_3741; 3740_3742; 3744_3750;
3746_3747; 3754_3756; 3755_3757; 3760_3763;
3764_3765; 3766_3767; 3767_3768; 3767_3770;
3780_3781; 3784_3785; 3787_3788; 3791_3792;
3794_3795; 3797_3798; 3800_3803; 3801_3802;

3817_3818; 3831_3832; 3833_3834; 3834_3836; 3834_3839; 3834_3840; 3835_3838; 3837_3839; 3850_3857; 3852_3859; 3854_3861; 3857_3858; 3857_3860; 3865_3866; 3868_3869; 3873_3875; 3874_3877; 3874_3878; 3874_3879; 3874_3880; 3874_3881; 3874_3882; 3874_3883; 3885_3886; 3885_3888; 3891_3892; 3893_3894; 3899_3900; 3904_3905; 3908_3909; 3909_3910; 3909_3911; 3914_3919; 3916_3917; 3920_3923; 3924_3928; 3925_3926; 3925_3927; 3945_3947; 3946_3948; 3946_3949; 3958_3959; 3970_3971; 3980_3981; 3981_3982; 3981_3983; 3985_3986; 3988_3989; 3997_3998; 4000_4002; 4016_4017; 4017_4020; 4018_4021; 4022_4027; 4023_4037; 4024_4027; 4025_4029; 4025_4030; 4027_4034; 4027_4035; 4027_4036; 4027_4038; 4042_4044; 4043_4044; 4044_4047; 4046_4048; 4049_4050; 4050_4052; 4055_4060; 4056_4057; 4056_4059; 4058_4059; 4061_4062; 4066_4091; 4067_4076; 4067_4096; 4068_4093; 4069_4096; 4071_4076; 4072_4096; 4073_4093; 4074_4096; 4075_4093; 4075_4096; 4076_4080; 4076_4081; 4076_4082; 4076_4083; 4076_4103; 4076_4106; 4077_4093; 4077_4096; 4079_4093; 4079_4094; 4080_4091; 4084_4096; 4085_4096; 4086_4096; 4087_4096; 4088_4096; 4089_4096; 4090_4096; 4093_4098; 4093_4105; 4093_4107; 4093_4108; 4093_4109; 4096_4099; 4096_4100; 4096_4102; 4096_4103; 4096_4104; 4096_4105; 4096_4107; 4096_4108; 4096_4109; 4113_4114; 4116_4117; 4125_4127; 4126_4128; 4127_4129; 4130_4131; 4133_4136; 4134_4140; 4134_4145; 4134_4146; 4135_4140; 4135_4142; 4135_4152; 4136_4139; 4137_4141; 4137_4151; 4140_4148; 4140_4153; 4142_4150; 4143_4149; 4147_4149; 4150_4152; 4155_4160; 4156_4157; 4156_4158; 4156_4159; 4161_4168; 4165_4167; 4166_4169; 4173_4179; 4174_4180; 4175_4176; 4176_4181; 4177_4180; 4186_4189; 4187_4188; 4190_4191; 4195_4197; 4196_4197; 4210_4211; 4211_4214; 4212_4213; 4217_4218; 4224_4225; 4225_4226; 4236_4248; 4237_4239; 4238_4249; 4240_4246; 4241_4247; 4241_4248; 4241_4249; 4242_4248; 4243_4248; 4245_4250; 4258_4259; 4261_4264; 4262_4261; 4267_4268; 4270_4273; 4271_4277; 4272_4275; 4275_4279; 4276_4279; 4283_4291; 4284_4285; 4287_4290; 4288_4290; 4294_4295; 4297_4302; 4297_4303; 4297_4304; 4297_4305; 4309_4313; 4310_4312; 4311_4315; 4312_4313; 4312_4314; 4315_4316; 4317_4322; 4318_4324; 4319_4323; 4321_4325; 4324_4325; 4326_4329; 4328_4333; 4328_4334; 4332_4335; 4353_4354; 4355_4356; 4361_4363; 4366_4367; 4366_4368; 4372_4373; 4374_4377; 4382_4383; 4383_4384; 4387_4390; 4387_4391; 4387_4392; 4387_4393; 4389_4392; 4392_4394; 4392_4395; 4396_4398; 4397_4398; 4401_4408; 4402_4403; 4402_4405; 4404_4407; 4404_4413; 4406_4408; 4408_4409; 4408_4410; 4408_4412; 4416_4417; 4417_4418; 4420_4421; 4422_4423; 4422_4424; 4436_4437; 4439_4442; 4440_4442; 4441_4442; 4442_4444; 4442_4445; 4442_4446; 4442_4447; 4442_4448; 4442_4449; 4442_4450; 4442_4451; 4442_4453; 4442_4454; 4442_4455; 4442_4456; 4442_4457; 4442_4458; 4442_4459; 4442_4460; 4442_4461; 4442_4463; 4464_4465; 4464_4466; 4465_4467; 4473_4474; 4476_4477; 4484_4487; 4493_4496; 4494_4496; 4498_4500; 4503_4504; 4510_4513; 4511_4527; 4512_4527; 4514_4519; 4517_4528; 4518_4526; 4519_4528; 4520_4527; 4522_4531; 4523_4527; 4523_4531; 4524_4527; 4533_4534; 4535_4537; 4538_4539; 4538_4540; 4538_4542; 4538_4544; 4538_4545; 4546_4557; 4561_4562; 4563_4564; 4563_4565; 4563_4566; 4563_4567; 4563_4568; 4563_4570; 4563_4571; 4563_4572; 4563_4573; 4569_4571; 4576_4577; 4578_4579; 4579_4580; 4585_4586; 4589_4590; 4598_4601; 4602_4607; 4603_4604; 4603_4605; 4603_4606; 4604_4607; 4607_4608; 4614_4615; 4625_4655; 4626_4629; 4627_4649; 4628_4639; 4629_4631; 4629_4634; 4629_4635; 4629_4638; 4629_4639; 4629_4640; 4629_4643; 4629_4644; 4629_4645; 4629_4648; 4629_4650; 4630_4654; 4631_4651; 4631_4654; 4631_4655; 4632_4652; 4635_4651; 4635_4654; 4635_4655; 4636_4654; 4636_4655; 4637_4654; 4637_4655; 4639_4651; 4640_4651; 4640_4654; 4640_4655; 4642_4654; 4645_4651; 4645_4655; 4646_4654; 4647_4654; 4650_4654; 4657_4667; 4668_4670; 4673_4674; 4680_4683; 4684_4687; 4689_4690; 4689_4696; 4691_4696; 4695_4697; 4699_4701; 4702_4703; 4704_4710; 4705_4710; 4706_4707; 4707_4708; 4719_4720; 4723_4733; 4724_4733; 4724_4735; 4724_4736; 4725_4733; 4726_4733; 4726_4736; 4727_4733; 4728_4733; 4728_4735; 4729_4731; 4730_4733; 4740_4749; 4740_4754; 4741_4752; 4741_4765; 4741_4769; 4742_4744; 4742_4765; 4742_4768; 4742_4771; 4744_4746; 4744_4747; 4744_4755; 4744_4757; 4744_4758; 4744_4762; 4744_4766; 4744_4772; 4744_4773; 4745_4764; 4746_4771; 4748_4765; 4749_4756; 4749_4759; 4749_4761; 4754_4759; 4754_4763; 4760_4767; 4775_4776; 4777_4778; 4785_4786; 4786_4787; 4786_4788; 4793_4795; 4793_4796; 4794_4795; 4800_4801; 4802_4803; 4814_4815; 4817_4818; 4819_4821; 4820_4822; 4823_4825; 4823_4829; 4834_4850; 4835_4839; 4836_4843; 4836_4846; 4836_4849; 4837_4844; 4838_4845; 4840_4846; 4841_4843; 4841_4846; 4841_4847; 4841_4849; 4842_4846; 4852_4854; 4855_4860; 4858_4860; 4864_4866; 4864_4871; 4877_4879; 4878_4881; 4880_4881; 4888_4894; 4889_4893; 4889_4894; 4890_4894; 4902_4903; 4905_4906; 4911_4913; 4912_4913; 4930_4931; 4939_4942; 4940_4941; 4945_4955; 4947_4951; 4950_4951; 4950_4956; 4971_4972; 4983_4984; 4989_4994; 4989_5000; 4990_4994; 4990_5000; 4990_5001; 4991_4994; 4991_5000; 4992_5006; 4992_5008; 4993_5001; 4995_5003; 4995_5007; 4995_5010; 4996_5009; 4997_5002; 5000_5002; 5000_5005; 5001_5008; 5013_5014; 5033_5034; 5035_5036; 5054_5055; 5054_5056; 5054_5058; 5062_5063; 5064_5067; 5067_5068; 5070_5080; 5071_5080; 5072_5080; 5074_5079; 5075_5080; 5077_5080; 5080_5081; 5080_5082; 5080_5083; 5085_5089; 5086_5087; 5087_5088; 5091_5096; 5091_5097; 5092_5095; 5093_5094; 5102_5103; 5105_5106; 5117_5118; 5120_5121; 5124_5126; 5127_5128; 5131_5132; 5142_5143; 5148_5151; 5149_5150; 5152_5153; 5168_5169; 5171_5172; 5178_5179; 5192_5197; 5193_5197; 5194_5197; 5207_5208; 5213_5221; 5215_5221; 5216_5221; 5217_5221; 5218_5229; 5220_5221; 5221_5222; 5221_5223; 5221_5224; 5221_5225; 5221_5226; 5221_5230; 5221_5232; 5227_5229; 5228_5234; 5235_5239;

5236_5239; 5239_5243; 5240_5247; 5242_5247; 5250_5251; 5253_5255; 5254_5256; 5258_5261; 5259_5260; 5262_5264; 5263_5264; 5266_5267; 5276_5285; 5277_5285; 5279_5285; 5280_5285; 5281_5285; 5283_5285; 5284_5287; 5285_5286; 5285_5287; 5291_5292; 5293_5294; 5293_5295; 5296_5297; 5296_5298; 5296_5299; 5296_5302; 5300_5301; 5308_5311; 5309_5311; 5309_5312; 5310_5311; 5314_5324; 5315_5316; 5315_5323; 5318_5320; 5319_5322; 5320_5321; 5320_5323; 5326_5327; 5339_5340; 5341_5344; 5342_5348; 5345_5347; 5346_5349; 5351_5352; 5351_5354; 5359_5360; 5364_5369; 5366_5367; 5367_5368; 5377_5379; 5378_5379; 5379_5382; 5380_5381; 5385_5386; 5385_5388; 5386_5387; 5389_5390; 5392_5394; 5392_5395; 5397_5398; 5398_5399; 5398_5400; 5398_5401; 5398_5402; 5398_5404; 5398_5405; 5398_5406; 5423_5424; 5430_5432; 5431_5433; 5437_5438; 5442_5444; 5445_5447; 5446_5449; 5448_5449; 5451_5452; 5451_5454; 5451_5455; 5451_5457; 5452_5459; 5452_5460; 5453_5458; 5454_5460; 5461_5464; 5462_5464; 5463_5464; 5471_5473; 5472_5474; 5476_5477; 5478_5480; 5478_5482; 5479_5487; 5481_5485; 5481_5486; 5481_5487; 5481_5488; 5483_5484; 5484_5489; 5491_5492; 5496_5497; 5501_5502; 5501_5503; 5501_5506; 5501_5509; 5504_5508; 5505_5507; 5507_5509; 5508_5510; 5511_5512; 5515_5519; 5.516_5519; 5517_5519; 5526_5527; 5532_5536; 5541_5542; 5543_5545; 5550_5551; 5551_5552; 5554_5556; 5555_5560; 5557_5558; 5558_5559; 5558_5563; 5567_5568; 5570_5573; 5571_5570; 5572_5574

The inventors then demonstrated that it is possible to define classification functions from such pairs of significant probe sets, as illustrated in the example below where a classification function is constructed from 51 probe set pairs identified for the three genes PSEN1, PTPRC and SORL1.

A score of 0 or +1 can then be associated with each probe set pair for each patient. A global score per patient is then obtained by adding the individual scores. Per individual, the minimum score is thus 0 and the maximum score is 51 (for these 51 pairs). The following rule can be applied: An individual will be classified as AD if his or her score is greater than 51/2=25.5 and an individual will be classified as control if his or her score is less than 51/2 =25.5. FIG. 3 indicates the scores obtained for the 80 AD and 70 controls. 83% of AD patients are properly classified and 93% of controls are properly classified.

Effective classification functions can thus be characterized from these significant probe pairs.

The advantage of an analysis dependent on the relative expression of probe sets is that this type of analysis should be insensitive or only slightly sensitive to the normalization process. It is thus possible to perform the same type of analysis from crude, non-normalized expression values. This analysis allows defining the TSP NN group represented by the following 1865 pair sequences according to scores above 0.5 (column H of Table 2):

SEQ ID Nos : 1_3; 1_9; 1_10; 1_11; 1_12; 1_13; 1_14; 3_4; 4_10; 7_9; 8_9; 23_24; 27_30; 32_33; 33_34; 33_35; 33_37; 44_49; 56_57; 64_65; 68_72; 69_73; 69_77; 69_78; 69_81; 69_82; 69_83; 70_83; 92_93; 95_96; 95_97; 106_107; 111_112; 122_124; 123_124; 129_130; 131_132; 135_139; 135_142; 135_144; 135_145; 135_147; 136_137; 136_138; 136_140; 136_141; 136_148; 151_152; 154_155; 158_159; 160_161; 161_162; 168_169; 168_170; 176_177; 185_186; 188_189; 194_198; 195_203; 195_210; 197_210; 200_205; 204_211; 205_208; 206_212; 214_215; 220_221; 223_224; 224_226; 224_227; 224_228; 224_230; 224_232; 224_233; 224_234; 224_235; 224_236; 224_237; 224_238; 224_239; 224_240; 224_241; 224_242; 224_243; 224_245; 224_246; 224_247; 224_248; 224_249; 224_250; 224_251; 224_252; 224_253; 224_254; 224_255; 224_256; 224_257; 224_258; 224_259; 231_224; 266_269; 267_269; 269_273; 270_272; 270_275; 279_281; 282_283; 287_288; 289_290; 296_297; 302_303; 303_305; 314_315; 318_319; 323_324; 326_327; 328_331; 329_332; 330_331; 331_333; 331_334; 331_335; 331_336; 344_346; 358_361; 359_360; 380_381; 383_384; 385_386; 386_391; 387_389; 393_395; 411_412; 415_418; 428_429; 429_430; 429_431; 433_434; 434_438; 447_453; 460_461; 463_464; 477_478; 477_479; 481_483; 484_485; 486_488; 486_489; 486_490; 486_492; 486_494; 486_495; 486_496; 486_497; 486_498; 486_500; 491_493; 525_526; 533_534; 545_547; 546_552; 547_553; 547_554; 549_551; 549_552; 562_563; 562_564; 575_578; 576_578; 577_578; 579_580; 584_585; 586_587; 588_589; 604_605; 610_611; 615_616; 621_629; 622_629; 623_629; 624_629; 627_629; 628_629; 629_630; 629_631; 629_632; 629_633; 639_640; 642_643; 644_645; 670_672; 674_675; 678_679; 680_681; 697_698; 699_702; 701_702; 717_718; 727_728; 729_730; 733_735; 742_744; 742_746; 742_747; 742_748; 742_749; 750_753; 755_756; 761_763; 765_767; 773_774; 779_781; 791_795; 791_798; 791_799; 791_800; 791_803; 791_814; 792_811; 793_811; 794_811; 796_800; 796_817; 796_824; 797_809; 797_811; 802_808; 804_811; 805_811; 806_825; 808_816; 808_823; 809_813; 809_820; 810_823; 811_813; 811_815; 811_818; 811_819; 811_820; 811_821; 811_822; 812_821; 827_829; 828_830; 832_835; 834_836; 835_837; 835_838; 835_841; 836_841; 838_840; 843_844; 848_851; 849_850; 852_853; 852_854; 856_863; 859_865; 861_864; 862_865; 869_870; 873_882; 874_882; 875_882; 876_882; 877_882; 879_882; 880_884; 881_884; 882_885; 886_889; 887_890; 888_890; 895_899; 895_900; 897_898; 899_901; 899_903; 900_902; 906_910; 908_911; 917_918; 937_938; 943_945; 943_946; 943_947; 944_947; 953_954; 960_961; 961_962; 961_964; 961_965; 961_967; 961_969; 970_971; 974_975; 993_1011; 994_1013; 995_1001; 995_1002; 995_1003; 996_999; 997_1000; 998_1009; 1000_1009; 1005_1011; 1006_1011; 1007_1011; 1008_1011; 1009_1010; 1018_1021; 1022_1025; 1035_1036; 1038_1039; 1047_1048; 1051_1052; 1054_1055; 1056_1063; 1057_1060; 1059_1061; 1065_1067; 1066_1067; 1067_1068; 1067_1069; 1067_1071; 1073_1074; 1081_1083; 1081_1084; 1087_1088; 1088_1089; 1088_1090; 1088_1092; 1097_1099; 1098_1101; 1098_1105; 1098_1106; 1098_1110; 1102_1117; 1103_1110; 1107_1111; 1107_1120; 1110_1118; 1110_1119; 1123_1133; 1124_1133; 1125_1126; 1125_1129; 1125_1130; 1125_1131; 1125_1132; 1135_1138; 1141_1144; 1143_1144; 1174_1177; 1180_1183; 1181_1182; 1182_1184; 1188_1192; 1189_1190; 1193_1194; 1196_1197; 1196_1198; 1199_1200; 1204_1205; 1208_1209; 1208_1210; 1212_1213; 1217_1237; 1219_

1239; 1221_1237; 1222_1239; 1223_1242; 1224_
1239; 1226_1244; 1226_1246; 1226_1261; 1227_
1245; 1228_1233; 1229_1233; 1229_1235; 1229_
1247; 1231_1237; 1233_1260; 1234_1242; 1234_
1259; 1236_1242; 1237_1243; 1237_1245; 1237_
1249; 1237_1251; 1237_1263; 1237_1264; 1237_
1265; 1237_1267; 1238_1245; 1238_1249; 1239_
1262; 1239_1266; 1239_1269; 1242_1248; 1242_
1250; 1242_1252; 1242_1255; 1245_1254; 1247_
1253; 1247_1254; 1248_1258; 1248_1259; 1249_
1254; 1275_1276; 1281_1285; 1282_1284; 1283_
1284; 1295_1296; 1295_1297; 1295_1298; 1299_
1305; 1299_1306; 1300_1303; 1301_1302; 1310_
1311; 1310_1316; 1310_1319; 1310_1320; 1310_
1325; 1312_1324; 1312_1327; 1313_1326; 1315_
1328; 1317_1326; 1318_1319; 1323_1329; 1323_
1330; 1326_1331; 1334_1337; 1335_1336; 1338_
1343; 1350_1352; 1351_1353; 1359_1360; 1368_
1372; 1369_1383; 1371_1374; 1376_1388; 1377_
1379; 1377_1381; 1378_1383; 1381_1391; 1383_
1392; 1384_1393; 1400_1402; 1402_1403; 1402_
1405; 1402_1407; 1402_1409; 1402_1410; 1402_
1411; 1403_1404; 1406_1408; 1408_1412; 1418_
1419; 1423_1427; 1424_1427; 1425_1427; 1426_
1427; 1429_1430; 1429_1431; 1433_1435; 1434_
1435; 1436_1437; 1443_1444; 1444_1446; 1448_
1450; 1448_1452; 1448_1453; 1448_1456; 1448_
1457; 1448_1458; 1448_1459; 1448_1460; 1448_
1464; 1448_1465; 1448_1468; 1449_1455; 1451_
1471; 1466_1469; 1475_1476; 1476_1480; 1476_
1481; 1476_1482; 1477_1478; 1478_1483; 1485_
1489; 1486_1490; 1488_1490; 1488_1499; 1490_
1492; 1490_1497; 1490_1500; 1501_1503; 1501_
1504; 1506_1505; 1511_1514; 1536_1539; 1537_
1539; 1538_1539; 1539_1544; 1541_1543; 1543_
1545; 1546_1548; 1546_1550; 1547_1549; 1553_
1554; 1553_1555; 1556_1558; 1557_1558; 1564_
1565; 1567_1572; 1568_1569; 1570_1571; 1570_
1574; 1572_1573; 1572_1574; 1586_1587; 1594_
1596; 1602_1601; 1603_1605; 1604_1606; 1610_
1615; 1611_1614; 1612_1615; 1613_1614; 1620_
1625; 1625_1626; 1636_1637; 1641_1642; 1641_
1643; 1641_1644; 1641_1645; 1641_1646; 1647_
1648; 1655_1657; 1656_1657; 1658_1659; 1658_
1660; 1658_1661; 1658_1662; 1658_1664; 1658_
1665; 1658_1666; 1680_1681; 1682_1685; 1683_
1684; 1683_1686; 1690_1693; 1703_1704; 1704_
1707; 1705_1707; 1706_1708; 1707_1708; 1711_
1712; 1715_1716; 1719_1720; 1726_1727; 1727_
1728; 1732_1738; 1733_1745; 1736_1745; 1737_
1741; 1738_1745; 1739_1745; 1745_1750; 1749_
1752; 1754_1755; 1754_1759; 1757_1758; 1760_
1761; 1768_1769; 1778_1781; 1780_1782; 1781_
1783; 1799_1800; 1803_1804; 1817_1818; 1817_
1819; 1822_1823; 1835_1837; 1842_1843; 1848_
1850; 1863_1866; 1865_1866; 1866_1867; 1866_
1868; 1866_1869; 1866_1872; 1866_1873; 1866_
1874; 1866_1875; 1866_1876; 1866_1877; 1866_
1878; 1866_1879; 1866_1880; 1866_1881; 1866_
1882; 1866_1883; 1866_1886; 1866_1887; 1866_
1888; 1866_1889; 1866_1890; 1866_1891; 1866_
1893; 1866_1895; 1866_1897; 1866_1900; 1866_
1902; 1866_1903; 1866_1904; 1866_1906; 1866_
1907; 1866_1908; 1866_1909; 1870_1866; 1921_
1922; 1921_1923; 1922_1927; 1922_1928; 1922_
1929; 1925_1932; 1925_1933; 1926_1934; 1936_
1937; 1939_1940; 1939_1941; 1939_1943; 1939_
1944; 1939_1945; 1949_1954; 1949_1955; 1957_
1958; 1957_1959; 1957_1960; 1965_1967; 1968_
1970; 1968_1973; 1974_1975; 1979_1980; 1981_
1982; 1988_1992; 1989_1990; 1991_1993; 1997_
1998; 2004_2005; 2013_2016; 2014_2016; 2018_
2019; 2026_2027; 2028_2029; 2029_2031; 2029_
2034; 2030_2032; 2030_2033; 2035_2036; 2035_
2037; 2039_2040; 2046_2048; 2051_2059; 2052_
2057; 2054_2058; 2055_2059; 2056_2059; 2065_
2067; 2065_2079; 2066_2069; 2067_2076; 2068_
2074; 2068_2077; 2070_2078; 2071_2082; 2072_
2073; 2072_2081; 2073_2075; 2075_2081; 2076_
2080; 2077_2083; 2077_2084; 2089_2090; 2091_
2092; 2094_2095; 2100_2104; 2101_2102; 2102_
2105; 2103_2105; 2138_2146; 2149_2152; 2149_
2153; 2150_2155; 2151_2155; 2151_2156; 2162_
2163; 2169_2171; 2169_2172; 2175_2176; 2178_
2179; 2178_2180; 2178_2181; 2183_2184; 2189_
2191; 2191_2193; 2191_2198; 2191_2200; 2192_
2199; 2196_2198; 2201_2202; 2205_2206; 2209_
2210; 2220_2223; 2221_2226; 2222_2226; 2224_
2226; 2226_2227; 2226_2228; 2226_2230; 2226_
2233; 2226_2234; 2236_2237; 2236_2238; 2239_
2240; 2244_2245; 2248_2262; 2251_2262; 2253_
2262; 2262_2265; 2273_2276; 2274_2276; 2275_
2276; 2282_2283; 2286_2287; 2286_2292; 2286_
2297; 2288_2299; 2289_2299; 2290_2299; 2291_
2299; 2291_2301; 2294_2298; 2295_2296; 2302_
2304; 2308_2309; 2335_2337; 2351_2355; 2351_
2357; 2353_2356; 2354_2359; 2363_2364; 2372_
2387; 2375_2388; 2403_2404; 2419_2420; 2422_
2424; 2423_2424; 2424_2427; 2424_2428; 2425_
2427; 2429_2430; 2431_2432; 2432_2433; 2432_
2434; 2437_2439; 2438_2440; 2455_2457; 2455_
2458; 2458_2466; 2459_2463; 2462_2463; 2464_
2467; 2470_2471; 2472_2473; 2472_2474; 2475_
2476; 2477_2478; 2477_2479; 2480_2481; 2482_
2483; 2487_2488; 2491_2492; 2496_2505; 2496_
2507; 2496_2509; 2497_2499; 2497_2504; 2497_
2505; 2497_2506; 2497_2508; 2497_2510; 2497_
2512; 2497_2516; 2498_2504; 2498_2505; 2498_
2509; 2498_2510; 2498_2511; 2498_2513; 2498_
2514; 2498_2515; 2501_2511; 2502_2509; 2502_
2511; 2502_2515; 2503_2508; 2525_2526; 2528_
2535; 2529_2537; 2532_2535; 2541_2570; 2541_
2572; 2542_2547; 2542_2550; 2542_2567; 2542_
2568; 2543_2567; 2544_2572; 2549_2544; 2549_
2545; 2549_2561; 2549_2576; 2551_2575; 2552_
2575; 2553_2557; 2554_2558; 2561_2572; 2561_
2573; 2562_2571; 2563_2566; 2563_2569; 2564_
2567; 2564_2568; 2572_2574; 2597_2598; 2608_
2609; 2609_2611; 2610_2611; 2614_2615; 2624_
2631; 2625_2626; 2626_2628; 2626_2629; 2627_
2630; 2634_2635; 2637_2639; 2640_2642; 2641_
2642; 2642_2643; 2644_2645; 2651_2655; 2652_
2653; 2652_2656; 2652_2657; 2654_2655; 2661_
2670; 2661_2671; 2662_2664; 2662_2671; 2663_
2669; 2664_2673; 2665_2667; 2666_2669; 2670_
2673; 2674_2675; 2677_2678; 2677_2688; 2677_
2689; 2677_2694; 2678_2686; 2678_2690; 2681_
2694; 2682_2685; 2682_2686; 2682_2687; 2682_
2690; 2683_2692; 2686_2688; 2686_2689; 2687_
2688; 2688_2690; 2689_2690; 2693_2694; 2704_
2705; 2706_2708; 2707_2711; 2715_2721; 2715_
2722; 2716_2718; 2716_2726; 2717_2726; 2718_
2722; 2719_2725; 2719_2727; 2722_2723; 2730_
2745; 2731_2732; 2732_2733; 2732_2734; 2732_

2735; 2732_2736; 2732_2737; 2732_2738; 2732_2739; 2746_2748; 2747_2748; 2748_2750; 2748_2757; 2748_2758; 2748_2759; 2749_2751; 2751_2756; 2753_2754; 2760_2761; 2764_2766; 2777_2779; 2778_2780; 2784_2786; 2785_2786; 2792_2794; 2797_2800; 2797_2810; 2798_2799; 2800_2807; 2800_2808; 2801_2810; 2802_2806; 2808_2810; 2812_2814; 2812_2815; 2819_2827; 2820_2822; 2821_2822; 2822_2829; 2826_2832; 2830_2832; 2836_2837; 2839_2840; 2840_2841; 2840_2842; 2846_2847; 2848_2849; 2854_2857; 2854_2864; 2854_2867; 2855_2858; 2855_2859; 2855_2861; 2856_2861; 2861_2865; 2875_2881; 2875_2884; 2878_2880; 2878_2883; 2878_2885; 2880_2882; 2911_2912; 2926_2927; 2928_2929; 2930_2931; 2948_2949; 2952_2953; 2952_2954; 2955_2959; 2955_2960; 2956_2961; 2957_2958; 2962_2965; 2963_2966; 2968_2971; 2969_2972; 2970_2972; 2974_2975; 2975_2977; 2995_2996; 2998_2999; 3001_3002; 3001_3003; 3006_3007; 3015_3023; 3016_3023; 3017_3018; 3017_3023; 3017_3026; 3018_3030; 3018_3032; 3019_3024; 3020_3023; 3021_3023; 3023_3022; 3023_3030; 3023_3032; 3023_3033; 3023_3034; 3027_3032; 3038_3039; 3039_3040; 3046_3048; 3047_3049; 3054_3056; 3057_3058; 3059_3060; 3062_3063; 3069_3070; 3077_3078; 3077_3083; 3077_3084; 3078_3080; 3078_3081; 3078_3082; 3079_3084; 3090_3092; 3091_3092; 3092_3094; 3092_3095; 3092_3096; 3092_3097; 3092_3098; 3100_3101; 3111_3112; 3111_3113; 3111_3114; 3111_3115; 3116_3117; 3120_3122; 3120_3142; 3121_3123; 3122_3125; 3122_3131; 3122_3133; 3122_3138; 3122_3139; 3122_3146; 3122_3147; 3123_3134; 3123_3135; 3123_3140; 3124_3143; 3124_3144; 3126_3130; 3127_3144; 3129_3145; 3132_3149; 3136_3144; 3136_3145; 3139_3142; 3141_3147; 3144_3148; 3150_3151; 3154_3155; 3174_3176; 3176_3181; 3177_3182; 3178_3180; 3179_3184; 3180_3183; 3198_3199; 3201_3202; 3209_3210; 3212_3214; 3227_3230; 3228_3231; 3229_3232; 3236_3238; 3236_3239; 3236_3240; 3236_3241; 3251_3256; 3253_3255; 3254_3255; 3257_3258; 3261_3263; 3264_3265; 3267_3271; 3269_3271; 3274_3275; 3287_3293; 3288_3289; 3290_3293; 3290_3294; 3290_3295; 3291_3293; 3316_3318; 3317_3321; 3318_3319; 3339_3344; 3342_3347; 3343_3348; 3351_3352; 3351_3353; 3354_3357; 3355_3363; 3357_3364; 3359_3363; 3367_3368; 3368_3369; 3382_3383; 3385_3396; 3386_3402; 3387_3395; 3387_3396; 3388_3398; 3388_3401; 3390_3391; 3390_3392; 3390_3400; 3391_3397; 3395_3405; 3396_3403; 3396_3404; 3396_3405; 3397_3399; 3406_3407; 3414_3415; 3418_3419; 3423_3424; 3425_3426; 3431_3436; 3433_3441; 3434_3439; 3435_3436; 3438_3440; 3444_3448; 3444_3465; 3444_3471; 3444_3472; 3445_3446; 3447_3454; 3447_3459; 3447_3460; 3449_3450; 3451_3472; 3454_3469; 3454_3470; 3456_3464; 3456_3465; 3457_3468; 3458_3466; 3458_3467; 3475_3477; 3475_3479; 3476_3477; 3478_3481; 3483_3484; 3492_3493; 3493_3495; 3494_3496; 3495_3497; 3498_3499; 3501_3504; 3511_3513; 3512_3513; 3513_3514; 3543_3544; 3544_3545; 3546_3549; 3550_3551; 3556_3557; 3568_3569; 3570_3571; 3584_3585; 3591_3592; 3591_3593; 3591_3594; 3605_3606; 3610_3611; 3610_3612; 3610_3614; 3610_3618; 3610_3619; 3610_3621; 3611_3622; 3613_3618; 3613_3619; 3613_3620; 3615_3618; 3630_3635; 3632_3634; 3632_3637; 3632_3641; 3633_3640; 3634_3636; 3638_3642; 3647_3648; 3651_3653; 3653_3654; 3653_3655; 3653_3656; 3653_3660; 3653_3661; 3653_3662; 3653_3663; 3653_3665; 3653_3666; 3653_3667; 3653_3669; 3677_3680; 3678_3695; 3679_3690; 3681_3682; 3682_3687; 3682_3693; 3682_3694; 3682_3697; 3683_3689; 3683_3696; 3684_3693; 3701_3702; 3710_3720; 3711_3719; 3716_3717; 3721_3724; 3723_3724; 3724_3726; 3724_3727; 3724_3728; 3724_3729; 3730_3731; 3735_3736; 3737_3741; 3738_3741; 3739_3741; 3740_3741; 3744_3745; 3744_3749; 3744_3750; 3746_3747; 3754_3756; 3755_3757; 3760_3763; 3764_3765; 3766_3767; 3767_3768; 3767_3769; 3767_3770; 3774_3775; 3779_3780; 3780_3781; 3784_3785; 3787_3788; 3800_3803; 3801_3802; 3817_3818; 3825_3827; 3831_3832; 3833_3834; 3834_3839; 3834_3840; 3837_3839; 3850_3857; 3852_3857; 3852_3859; 3857_3858; 3857_3860; 3865_3866; 3868_3869; 3873_3875; 3874_3876; 3874_3877; 3874_3881; 3874_3883; 3885_3887; 3891_3892; 3893_3894; 3901_3902; 3903_3904; 3904_3905; 3906_3907; 3908_3909; 3909_3910; 3909_3911; 3918_3922; 3920_3923; 3924_3928; 3925_3926; 3925_3927; 3941_3942; 3945_3947; 3946_3948; 3946_3949; 3980_3981; 3980_3984; 3985_3986; 3988_3989; 3997_3998; 3999_4003; 4000_4002; 4023_4037; 4024_4027; 4025_4029; 4026_4027; 4027_4033; 4027_4035; 4027_4036; 4028_4032; 4031_4036; 4041_4045; 4042_4044; 4043_4044; 4044_4047; 4046_4048; 4049_4050; 4050_4052; 4055_4060; 4056_4059; 4057_4058; 4061_4062; 4067_4076; 4067_4096; 4068_4093; 4069_4093; 4069_4096; 4071_4076; 4073_4093; 4075_4093; 4075_4096; 4076_4101; 4077_4093; 4077_4096; 4079_4093; 4079_4094; 4079_4096; 4085_4096; 4086_4096; 4087_4096; 4088_4096; 4089_4096; 4090_4096; 4093_4098; 4093_4105; 4093_4107; 4093_4108; 4093_4109; 4093_4110; 4096_4099; 4096_4100; 4096_4103; 4096_4104; 4096_4105; 4096_4107; 4096_4109; 4113_4114; 4116_4117; 4118_4120; 4122_4123; 4125_4127; 4127_4129; 4130_4131; 4132_4136; 4133_4136; 4134_4140; 4135_4138; 4135_4140; 4135_4142; 4135_4152; 4136_4139; 4136_4144; 4137_4141; 4137_4151; 4140_4148; 4140_4153; 4142_4150; 4143_4149; 4147_4149; 4150_4152; 4155_4160; 4156_4157; 4156_4158; 4156_4159; 4162_4163; 4165_4167; 4166_4169; 4175_4176; 4176_4181; 4177_4180; 4178_4180; 4190_4191; 4195_4197; 4196_4197; 4203_4204; 4205_4208; 4210_4211; 4211_4214; 4215_4216; 4217_4218; 4224_4225; 4236_4248; 4237_4239; 4238_4249; 4240_4246; 4241_4249; 4243_4248; 4244_4246; 4251_4252; 4253_4254; 4258_4259; 4261_4263; 4262_4261; 4270_4273; 4271_4277; 4272_4275; 4274_4278; 4283_4291; 4284_4285; 4286_4289; 4287_4290; 4288_4290; 4294_4295; 4297_4303; 4297_4305; 4301_4304; 4309_4313; 4310_4312; 4311_4315; 4312_4313; 4312_4314; 4315_4316; 4317_4322; 4318_4324; 4319_4320; 4319_4323; 4321_4325; 4324_4325; 4328_4333; 4328_4334; 4332_4335; 4338_4339; 4355_4356; 4360_4362; 4361_4363; 4366_4369; 4385_4392; 4387_4390; 4387_4391; 4387_4392;

4387_4393; 4396_4398; 4404_4407; 4404_4413; 4406_4408; 4408_4409; 4408_4411; 4408_4412; 4414_4415; 4416_4417; 4417_4418; 4420_4421; 4422_4424; 4436_4437; 4440_4442; 4441_4442; 4442_4443; 4442_4444; 4442_4446; 4442_4449; 4442_4450; 4442_4452; 4442_4453; 4442_4454; 4442_4455; 4442_4456; 4442_4457; 4442_4458; 4442_4459; 4442_4462; 4464_4465; 4464_4466; 4465_4467; 4473_4474; 4476_4477; 4477_4478; 4484_4487; 4485_4486; 4490_4491; 4493_4496; 4494_4496; 4498_4500; 4503_4504; 4510_4513; 4510_4530; 4511_4527; 4512_4527; 4514_4519; 4514_4521; 4516_4526; 4516_4529; 4520_4527; 4520_4531; 4523_4527; 4524_4527; 4533_4534; 4535_4536; 4535_4537; 4538_4539; 4538_4540; 4538_4543; 4538_4545; 4539_4541; 4550_4557; 4561_4562; 4563_4564; 4563_4565; 4563_4566; 4563_4567; 4563_4568; 4563_4570; 4563_4571; 4563_4572; 4563_4573; 4569_4571; 4576_4577; 4579_4580; 4585_4586; 4588_4589; 4589_4590; 4597_4600; 4598_4599; 4603_4604; 4603_4605; 4603_4606; 4604_4607; 4606_4607; 4607_4608; 4614_4615; 4614_4616; 4625_4629; 4625_4651; 4625_4655; 4626_4629; 4627_4649; 4629_4631; 4629_4634; 4629_4635; 4629_4638; 4629_4639; 4629_4640; 4629_4643; 4629_4644; 4629_4645; 4629_4648; 4629_4650; 4629_4653; 4630_4654; 4631_4651; 4631_4654; 4631_4655; 4632_4652; 4633_4652; 4635_4651; 4635_4654; 4635_4655; 4636_4654; 4636_4655; 4637_4651; 4637_4654; 4637_4655; 4639_4651; 4640_4651; 4640_4654; 4640_4655; 4641_4655; 4642_4654; 4645_4651; 4645_4655; 4647_4654; 4648_4654; 4657_4667; 4668_4670; 4669_4670; 4673_4674; 4681_4682; 4684_4685; 4684_4686; 4684_4687; 4689_4690; 4695_4697; 4702_4703; 4704_4710; 4705_4710; 4706_4707; 4707_4708; 4709_4710; 4719_4720; 4723_4733; 4724_4733; 4724_4735; 4724_4736; 4726_4733; 4726_4736; 4728_4733; 4729_4731; 4739_4763; 4740_4749; 4740_4754; 4741_4743; 4741_4753; 4741_4765; 4741_4769; 4742_4744; 4742_4765; 4742_4768; 4742_4770; 4744_4746; 4744_4747; 4744_4755; 4744_4757; 4744_4758; 4744_4762; 4744_4766; 4744_4772; 4745_4764; 4746_4771; 4749_4761; 4750_4768; 4751_4763; 4754_4759; 4760_4765; 4760_4767; 4768_4774; 4771_4772; 4775_4776; 4784_4786; 4785_4786; 4786_4787; 4786_4788; 4793_4795; 4793_4796; 4794_4795; 4814_4815; 4817_4818; 4819_4821; 4820_4822; 4830_4832; 4834_4850; 4836_4843; 4836_4848; 4838_4845; 4840_4846; 4841_4843; 4841_4846; 4841_4847; 4841_4849; 4842_4846; 4852_4853; 4852_4854; 4855_4860; 4858_4860; 4863_4870; 4864_4866; 4864_4871; 4877_4879; 4878_4881; 4880_4881; 4881_4882; 4888_4894; 4889_4893; 4889_4894; 4890_4894; 4902_4903; 4902_4904; 4911_4913; 4914_4915; 4916_4919; 4930_4931; 4936_4937; 4939_4942; 4940_4941; 4947_4951; 4950_4951; 4971_4972; 4983_4984; 4989_4994; 4989_5000; 4990_5000; 4990_5001; 4991_5000; 4992_5006; 4992_5008; 4993_5001; 4995_5003; 4995_5007; 4995_5010; 4996_5009; 5000_5002; 5000_5005; 5001_5008; 5013_5014; 5031_5032; 5033_5034; 5040_5042; 5054_5055; 5054_5056; 5054_5058; 5064_5067; 5067_5068; 5070_5080; 5071_5080; 5072_5080; 5073_5080; 5074_5079; 5075_5080; 5076_5078; 5077_5080; 5080_5081; 5080_5082; 5080_5083; 5086_5087; 5087_5088; 5091_5096; 5092_5095; 5093_5094; 5102_5103; 5105_5106; 5114_5115; 5127_5128; 5129_5130; 5149_5150; 5152_5153; 5176_5177; 5178_5179; 5192_5197; 5193_5197; 5194_5197; 5214_5221; 5215_5221; 5216_5221; 5217_5221; 5219_5221; 5220_5221; 5221_5222; 5221_5223; 5221_5224; 5221_5225; 5221_5230; 5221_5232; 5227_5229; 5235_5239; 5236_5237; 5236_5239; 5239_5243; 5240_5247; 5242_5247; 5246_5248; 5250_5251; 5252_5254; 5258_5261; 5259_5260; 5263_5264; 5275_5278; 5276_5285; 5277_5285; 5279_5282; 5279_5285; 5280_5285; 5281_5285; 5283_5285; 5284_5287; 5285_5286; 5285_5287; 5291_5292; 5293_5294; 5293_5295; 5296_5297; 5296_5302; 5300_5301; 5303_5304; 5306_5307; 5308_5311; 5309_5311; 5309_5312; 5310_5311; 5311_5313; 5315_5316; 5319_5322; 5319_5323; 5320_5321; 5320_5323; 5339_5340; 5345_5347; 5346_5349; 5351_5352; 5351_5354; 5356_5360; 5357_5358; 5359_5360; 5361_5362; 5364_5369; 5366_5367; 5367_5368; 5377_5379; 5378_5379; 5379_5382; 5385_5386; 5385_5388; 5386_5387; 5389_5390; 5392_5393; 5392_5394; 5392_5395; 5397_5398; 5398_5399; 5398_5400; 5398_5403; 5418_5420; 5422_5424; 5423_5424; 5424_5426; 5424_5427; 5431_5433; 5445_5447; 5446_5449; 5448_5449; 5451_5452; 5451_5454; 5451_5455; 5451_5457; 5452_5459; 5453_5458; 5454_5456; 5461_5464; 5462_5464; 5463_5464; 5471_5473; 5471_5475; 5476_5477; 5478_5480; 5478_5482; 5479_5487; 5481_5486; 5481_5487; 5481_5488; 5484_5489; 5490_5493; 5496_5497; 5501_5502; 5501_5503; 5501_5506; 5504_5508; 5508_5510; 5514_5519; 5515_5519; 5516_5519; 5517_5519; 5543_5545; 5544_5546; 5547_5548; 5550_5551; 5551_5552; 5554_5556; 5555_5560; 5557_5558; 5558_5559; 5558_5563; 5565_5566; 5567_5568; 5570_5573; 5571_5570; 5572_5574

78% of the pairs of this group are present in the TSP N group established from normalized values.

Finally, such an analysis is also possible by comparing probe sets coming from different genes. We performed this analysis from 1300 of the most significant probe sets resulting from ANOVA analysis. A threshold set at 0.6 allows characterizing 406 pairs forming the TSP 1300 SS group (column G of Table 2), associated with the following pair sequences:

SEQ ID NO: 118_5254; 153_2416; 153_2732; 153_4779; 184_4493; 293_1731; 301_2727; 306_455; 306_614; 306_770; 306_1422; 306_1585; 306_1694; 306_1971; 306_2343; 306_2732; 306_2913; 306_3000; 306_3957; 306_4076; 306_4091; 306_4096; 306_4097; 306_4194; 306_4550; 306_4620; 306_4779; 306_5201; 306_5206; 306_5254; 306_5419; 354_5555; 374_1767; 382_1641; 382_2017; 382_2188; 382_3043; 382_3533; 382_3576; 382_3724; 382_3855; 382_4093; 382_4094; 382_4552; 382_4905; 382_5067; 382_5198; 382_5257; 382_5386; 397_2023; 397_3685; 422_3043; 427_5467; 432_4093; 439_1767; 444_3590; 444_5555; 448_3590; 448_5555; 449_4963; 455_3211; 473_2725; 473_2727; 473_5238; 506_1641; 506_4093; 510_3043; 510_4905; 510_5257; 530_1767; 594_3043; 598_2023; 629_673; 648_1749; 648_4493; 650_5196; 664_759; 665_4493; 708_1242; 712_1641; 712_4096; 716_1239; 751_1834; 751_2128; 751_2144; 751_2543; 751_2725; 751_2727; 751_5238; 752_2727; 757_3250; 758_

2900; 758_3935; 758_5555; 842_3552; 846_1641; 846_4096; 892_1161; 892_5257; 893_2944; 921_3211; 973_1834; 973_2543; 973_2727; 981_1641; 981_4093; 992_1767; 1122_4093; 1142_1834; 1142_2543; 1142_2727; 1159_2943; 1170_2900; 1170_3540; 1170_5555; 1174_1270; 1174_3211; 1185_2023; 1185_3685; 1216_5221; 1237_2900; 1237_4220; 1237_5555; 1239_1767; 1239_5090; 1239_5549; 1240_2943; 1242_1860; 1242_2941; 1242_2944; 1242_3312; 1242_3537; 1242_3540; 1242_4716; 1258_2941; 1258_2944; 1259_2941; 1259_2944; 1287_1767; 1288_1971; 1422_1766; 1422_3211; 1489_2900; 1489_2941; 1489_3540; 1489_5555; 1534_3043; 1564_2462; 1591_2725; 1591_2727; 1629_4493; 1633_2401; 1641_2157; 1641_4875; 1641_4963; 1641_5173; 1654_3211; 1675_4811; 1694_1766; 1694_4383; 1694_4875; 1731_2900; 1731_5555; 1731_5561; 1744_2900; 1744_2941; 1744_3312; 1744_3540; 1744_3590; 1744_4714; 1744_5555; 1747_2900; 1747_2941; 1747_3312; 1747_3540; 1747_4220; 1747_4714; 1747_5555; 1749_3372; 1749_5090; 1749_5332; 1749_5555; 1766_2732; 1766_4096; 1767_2226; 1767_4469; 1767_4736; 1767_4925; 1767_4955; 1767_5196; 1767_5198; 1834_2073; 1834_3068; 1834_4560; 1834_5205; 1846_2941; 1849_3312; 1853_2941; 1853_2944; 1853_3540; 1859_2023; 1859_3685; 1860_1951; 1860_2406; 1860_2695; 1860_3222; 1911_2732; 1911_4076; 1911_4096; 1911_4779; 1911_5206; 1911_5419; 1920_3043; 1920_4905; 1920_5198; 1951_2943; 1951_2944; 1972_2049; 1972_3189; 1972_3211; 1987_3043; 2023_2889; 2023_3506; 2023_3979; 2023_4425; 2023_4872; 2049_2732; 2049_4091; 2049_5206; 2073_2128; 2073_2141; 2073_2143; 2073_2144; 2073_2312; 2073_2325; 2073_2332; 2073_2543; 2073_2679; 2073_2725; 2073_2727; 2073_5238; 2115_2943; 2128_2330; 2128_4587; 2139_2941; 2139_2944; 2143_2943; 2157_4093; 2157_4094; 2158_2329; 2186_4905; 2226_3272; 2226_3306; 2250_3590; 2250_5555; 2250_5561; 2255_3590; 2257_3590; 2261_3590; 2263_4714; 2310_2941; 2312_3538; 2313_2943; 2313_3538; 2324_2943; 2324_2944; 2326_2943; 2326_2944; 2329_4388; 2330_2725; 2330_2727; 2330_5238; 2332_3538; 2384_2943; 2384_2944; 2398_5555; 2401_3782; 2406_2943; 2406_2944; 2411_2900; 2411_2941; 2411_3312; 2411_3540; 2411_4220; 2411_4714; 2411_5555; 2412_2941; 2412_3537; 2412_3540; 2412_4220; 2416_3211; 2462_3067; 2543_4560; 2590_2943; 2590_2944; 2590_3538; 2593_2941; 2595_3043; 2595_4905; 2605_3043; 2607_2725; 2607_2727; 2678_3590; 2679_2943; 2679_3538; 2692_2900; 2692_2941; 2692_3540; 2695_2941; 2695_2944; 2695_3312; 2714_4383; 2714_4875; 2725_2943; 2725_3208; 2725_3538; 2725_4587; 2725_4715; 2727_3538; 2727_3816; 2727_4560; 2727_4587; 2732_3211; 2732_4508; 2769_4096; 2782_4096; 2787_3043; 2787_4094; 2787_4905; 2787_5257; 2870_3043; 2891_2943; 2900_4495; 2900_4592; 2900_5051; 2901_3043; 2941_3220; 2941_3531; 2941_4592; 2941_4660; 2941_5355; 2941_5529; 2943_3222; 2943_4235; 2943_5050; 2943_5238; 2944_3222; 2944_3320; 2944_3531; 2944_4502; 2944_5355; 2944_5529; 2983_4963; 3043_3327; 3043_3674; 3043_4231; 3043_4959; 3043_5328; 3189_5254; 3211_4076; 3211_4091; 3211_4097; 3211_4751; 3211_4779; 3211_5206; 3211_5419; 3312_4592; 3317_5555; 3372_4493; 3372_4736; 3417_4096; 3538_3575; 3538_5238; 3540_4592; 3575_4587; 3674_4905; 4093_4875; 4093_4963; 4093_5173; 4093_5435; 4094_4963; 4094_5328; 4096_4383; 4096_4717; 4096_4875; 4096_5173; 4096_5274; 4096_5436; 4185_4493; 4231_4905; 4256_5238; 4376_5221; 4398_4963; 4470_5555; 4493_4901; 4493_5090; 4493_5555; 4495_5555; 4508_4779; 4587_5238; 4592_4714; 4736_5090; 4736_5549; 4865_5555; 4905_4959; 4905 5328

EXAMPLE 4

Identification of New Isoforms of PTPRC, SORL1 and PSEN1

The analysis of the relative expressions of probe sets associated with the PTPRC, SORL1 and PSEN1 genes (see section 9) identified intron-exon or exon-intron junction probes revealing the potential presence of new isoforms. These isoforms are described below.

PTPRC: The sequence SEQ ID NO: 3679 corresponds to the junction between intron 5 and exon 6 of the PTPRC gene. The expression values associated with this probe suggest that a splicing event exists at the 5' end of exon 6. In order to characterize this event, RT-PCR tests were performed on pools of AD patients or controls by means of a primer situated in the 3' end of intron 5 combined with a primer corresponding to exons 2 or 4. Amplicons are visualized by electrophoresis (FIG. 4A). Sequencing these amplicons shows the use of a new alternative consensus acceptor site situated 37 nucleotides upstream from the usual site for exon 6. The messenger RNA including this event could encode a protein of 208 amino acids (the first 144 corresponding to the N-terminal part of CD45 (PTPRC). The other amplicons correspond to the same splicing event associated with deletions of exon 4 or exon 4 and exon 5. The RT-PCR tests suggest that this new splicing event is specifically down-regulated in the AD population. The sequence SEQ ID NO: 3698 corresponds to the extension of 37 nucleotides specific for this event. The sequence SEQ ID NO: 3699 corresponds to the new junction between exon 5 and the new 5'-extended exon 6.

SORL1: The sequence SEQ ID NO: 4027 corresponds to the junction between exon 41 and intron 41 of the SORL1 gene. The expression values associated with this probe suggest that a splicing event exists at the 3' end of exon 41. In order to characterize this event, RT-PCR tests were performed on pools of AD patients or controls by means of a primer situated in the 5' end of intron 41 combined with a primer corresponding to exon 42. Amplicons are visualized by electrophoresis (FIG. 4B). Sequencing these amplicons shows the use of a new alternative consensus donor site situated 28 nucleotides downstream from the usual site for exon 41. A STOP codon is situated in this extension, suggesting that an associated messenger RNA would code for a truncated protein of 1870 amino acids not containing the transmembrane domain and the cytoplasmic tail. The sequence SEQ ID NO: 4039 corresponds to the extension of 28 nucleotides specific for this event. The sequence SEQ ID NO: 4040 corresponds to the new junction between new 3'-extended exon 41 and exon 42.

PSEN1: RT-PCR tests were performed on pools of AD patients or controls by means of a primer situated in a known alternative exon situated between exon 3 and 4 of PSEN1 (represented by EST AK122722.1), combined with a primer corresponding to exon 4. Amplicons are visualized by electrophoresis (Figure C). Sequencing these amplicons shows the use of a new alternative donor site located in the alternative exon 935 nucleotides upstream of the usual site for this alternative exon (position 72704987-88 of chromosome 14). The RT-PCR tests suggest that this new splicing event is specifically expressed in the AD population. The sequence SEQ ID NO: 3515 corresponds to the truncated alternative exon. The sequence SEQ ID NO: 3516 corresponds to the new junction between the new truncated alternative exon and exon 4.

EXAMPLE 5

Discrimination Between AD Patients, MCI Patients and Controls

Groups of probes were selected from among SEQ ID NO: 1-5578, which allow discriminating between patients with AD and control subjects, or between MCI patients and control subjects or between MCI subjects and AD patients.

The possibility of distinguishing MCI and AD patients is particularly important. In fact, 30-40% of subjects with MCI will progress to AD. The possibility of identifying these subjects from the MCI stage allows initiating effective treatment protocols for AD without waiting for the disease to progress.

The RNA of 9 patients with MCI, 11 patients with AD and 11 control subjects was extracted from venous blood, reverse-transcribed and labeled with biotin, and then hybridized on GWSA arrays. These arrays were next washed, visualized, and then scanned (Affymetrix scanner). The .CEL files were then imported into Partek statistical analysis software. All these steps were performed as described previously (see pages 28 to 32).

After normalization of the data, 5562 groups of probes from among the 5578 were filtered from the list of 1,455,615 of groups of probes composing the file. The corresponding graphs are given in FIG. 5.

A 1-way ANOVA test then allows identifying the statistically-significant groups of probes for the AD vs. MCI, AD vs. C and C vs. MCI conditions. Three files were then generated from the ANOVA test results, containing the 84, 366 and 969 first statistically-significant sets of probe groups for the AD vs. MCI, AD vs. C and MCI vs. C conditions, respectively. Groups of probes specific for the AD vs. MCI, AD vs. C and MCI vs. C conditions were then identified; these data permitted generating the Venn diagram. The groups of probes specific for each of these conditions are particularly pertinent to discriminate these different clinical statuses of the patients.

5.1. Sub-Sets of Probe Groups Specific for AD Vs. MCI.

| p-value cut-off | Anova test | AD vs. MCI specific probe sets |
| --- | --- | --- |
| 0.01 | 84 | 27 |
| 0.001 | 10 | 6 |

The names of the groups of probe sub-sets 6PS and 27PS are given in the table below.

| Set 1: 6 PS AD vs. MCI | SEQ ID | Set 2: 27 PS AD vs. MCI | SEQ ID |
| --- | --- | --- | --- |
| 399.009.1-B | 2363 | 1019.005.1-T | 53 |
| 399.010.1-B | 2364 | 151888.002.1-B | 613 |
| 9467.009.1-E | 5307 | 1729.004.4-T | 697 |
| 9730.027.1-T | 5426 | 1803.025.1-B | 709 |
| 6934.032.1-B | 4218 | 23161.034.1-T | 1200 |
| 8603.000.5-X | 5063 | 23178.025.1-B | 1205 |
|  |  | 23312.005.1-F | 1339 |
|  |  | 284701.000.14-X | 1846 |
|  |  | 3486.024.1-C | 2157 |
|  |  | 3837.009.1-T | 2289 |
|  |  | 399.009.1-B | 2363 |
|  |  | 4054.000.26-Z | 2429 |
|  |  | 442065.001.1-T | 2600 |
|  |  | 4670.020.1-B | 2639 |
|  |  | 4678.001.3-B | 2642 |
|  |  | 4820.026.1-B | 2712 |
|  |  | 56261.011.1-B | 3503 |
|  |  | 57680.013.1-B | 3636 |
|  |  | 57680.028.1-B | 3641 |
|  |  | 7919.040.1-B | 4529 |
|  |  | 80024.005.1-T | 4671 |
|  |  | 8556.016.1-T | 5055 |
|  |  | 8603.000.5-X | 5063 |
|  |  | 9282.000.20-X | 5219 |
|  |  | 9467.009.1-E | 5307 |
|  |  | 9611.052.1-F | 5354 |
|  |  | 9730.027.1-T | 5426 |

Set 1 thus contains:

from 1 to 3 probes, overlapping or not, each comprising all or part of SEQ ID NO: 2363 or its complementary sequence;

from 1 to 3 probes, overlapping or not, each comprising all or part of SEQ ID NO: 2364 or its complementary sequence;

from 1 to 3 probes, overlapping or not, each comprising all or part of SEQ ID NO: 5307 or its complementary sequence;

from 1 to 3 probes, overlapping or not, each comprising all or part of SEQ ID NO: 5426 or its complementary sequence;

from 1 to 3 probes, overlapping or not, each comprising all or part of SEQ ID NO: 4218 or its complementary sequence; and from 1 to 3 probes, overlapping or not, each comprising all or part of SEQ ID NO: 5063 or its complementary sequence.

In a similar manner, set 2 contains 1-3 probes comprising all or part of each sequence identified above or its complementary strand.

In one specific example, set 1 and set 2 respectively contain the probes identified in Table 3.

The signal intensity ratio after subtracting background noise between the patient groups for each probe group is given below.

|  | Variation factor (AD vs. MCI) |
| --- | --- |
| Set 1 |  |
| 9730.027.1-T | 1.65331 |
| 399.009.1-B | −1.92241 |
| 399.010.1-B | −1.95279 |
| 9467.009.1-E | 1.46337 |
| 8603.000.5-X | 1.76215 |
| 6934.032.1-B | 2.01881 |

-continued

| | Variation factor (AD vs. MCI) |
|---|---|
| Set 2 | |
| 9730.027.1-T | 1.65331 |
| 399.009.1-B | −1.92241 |
| 9467.009.1-E | 1.46337 |
| 8603.000.5-X | 1.76215 |
| 56261.011.1-B | −1.47064 |
| 442065.001.1-T | 1.31817 |
| 9611.052.1-F | 1.55709 |
| 80024.005.1-T | −1.3923 |
| 23161.034.1-T | −1.73865 |
| 57680.013.1-B | 1.36043 |
| 8556.016.1-T | −1.414 |
| 4054.000.26-Z | 1.36387 |
| 23312.005.1-F | 1.4399 |
| 1019.005.1-T | −1.39817 |
| 151888.002.1-B | −1.8663 |
| 284701.000.14-X | −1.27164 |
| 1803.025.1-B | −1.50387 |
| 7919.040.1-B | −1.32556 |
| 4820.026.1-B | −1.44063 |
| 4678.001.3-B | −2.01683 |
| 23178.025.1-B | −2.34804 |
| 57680.028.1-B | 1.3464 |
| 4670.020.1-B | 1.76039 |
| 1729.004.4-T | 1.56877 |
| 3486.024.1-C | −1.30762 |
| 9282.000.20-X | 1.27867 |
| 3837.009.1-T | 1.2558 |

5.2. Sub-Sets of Probe Groups Specific for AD Vs. Controls.

| p-value cut-off | Anova test | AD vs. C specific probe sets |
|---|---|---|
| 0.01 | 366 | 75 |
| 0.001 | 54 | 18 |

The names of the probes of sub-set 18 PS are given in the table below.

| Set 3: 18 PS ADvsC | SEQ ID |
|---|---|
| 55652.007.1-D | 3325 |
| 140564.002.2-B | 568 |
| 10250.000.13-X | 67 |
| 55833.001.2-B | 3408 |
| 402483.005.1-B | 2406 |
| 55700.021.1-T | 3337 |
| 55636.003.1-T | 3323 |
| 2690.003.1-B | 1724 |
| 143.000.1-X | 573 |
| 54882.014.1-B | 3180 |
| 6813.005.1-T | 4178 |
| 23067.007.1-T | 1096 |
| 5527.004.1-F | 3288 |
| 9883.024.1-T | 5523 |
| 441124.002.1-T | 2590 |
| 79623.000.12-Y | 4558 |
| 5930.016.1-F | 3757 |
| 808.038.1-C | 4735 |

Set 3 thus contains:
from 1 to 3 probes, overlapping or not, each comprising all or part of SEQ ID NO: 3325 or its complementary sequence;
from 1 to 3 probes, overlapping or not, each comprising all or part of SEQ ID NO: 568 or its complementary sequence;
from 1 to 3 probes, overlapping or not, each comprising all or part of SEQ ID NO: 67 or its complementary sequence;
from 1 to 3 probes, overlapping or not, each comprising all or part of SEQ ID NO: 3408 or its complementary sequence;
from 1 to 3 probes, overlapping or not, each comprising all or part of SEQ ID NO: 2406 or its complementary sequence;
from 1 to 3 probes, overlapping or not, each comprising all or part of SEQ ID NO: 3337 or its complementary sequence;
from 1 to 3 probes, overlapping or not, each comprising all or part of SEQ ID NO: 3323 or its complementary sequence;
from 1 to 3 probes, overlapping or not, each comprising all or part of SEQ ID NO: 1724 or its complementary sequence;
from 1 to 3 probes, overlapping or not, each comprising all or part of SEQ ID NO: 573 or its complementary sequence;
from 1 to 3 probes, overlapping or not, each comprising all or part of SEQ ID NO: 3180 or its complementary sequence;
from 1 to 3 probes, overlapping or not, each comprising all or part of SEQ ID NO: 4178 or its complementary sequence;
from 1 to 3 probes, overlapping or not, each comprising all or part of SEQ ID NO: 1096 or its complementary sequence;
from 1 to 3 probes, overlapping or not, each comprising all or part of SEQ ID NO: 3288 or its complementary sequence;
from 1 to 3 probes, overlapping or not, each comprising all or part of SEQ ID NO: 5523 or its complementary sequence;
from 1 to 3 probes, overlapping or not, each comprising all or part of SEQ ID NO: 2590 or its complementary sequence;
from 1 to 3 probes, overlapping or not, each comprising all or part of SEQ ID NO: 4558 or its complementary sequence;
from 1 to 3 probes, overlapping or not, each comprising all or part of SEQ ID NO: 3757 or its complementary sequence; and
from 1 to 3 probes, overlapping or not, each comprising all or part of SEQ ID NO: 4735 or its complementary sequence.

In one specific example, set 3 contains the probe groups identified in Table 3.

The signal intensity ratio after subtracting background noise between the patient groups for each probe group is given below.

| Set 3 | Variation factor (AD vs. C) |
|---|---|
| 55652.007.1-D | −1.17521 |
| 143.000.1-X | 2.06971 |
| 55833.001.2-B | −1.75477 |
| 6813.005.1-T | −1.46021 |
| 23067.007.1-T | −1.92904 |
| 441124.002.1-T | −1.28295 |
| 402483.005.1-B | −1.2913 |
| 9883.024.1-T | −1.48769 |
| 55700.021.1-T | −1.51693 |

-continued

| Set 3 | Variation factor (AD vs. C) |
|---|---|
| 10250.000.13-X | −1.93485 |
| 79623.000.12-Y | −1.49027 |
| 140564.002.2-B | −1.7224 |
| 5930.016.1-F | 1.53811 |
| 55636.003.1-T | −1.54333 |
| 5527.004.1-F | 1.47689 |
| 54882.014.1-B | −1.33383 |
| 808.038.1-C | −1.62719 |
| 2690.003.1-B | −1.0767 |

5.3. Sub-Sets of Probe Groups Specific for MCI Vs. Controls.

| p-value cut-off | Anova test | MCI vs. C specific probe sets |
|---|---|---|
| 0.01 | 969 | 635 |
| 0.001 | 413 | 373 |
| 0.0001 | 149 | |
| 0.0000 | 133 | |

The names of the probes of sub-set 33PS are given in the table below.

| Set 4: 33PS | SEQ ID |
|---|---|
| 10163.000.7-X | 42 |
| 10163.008.1-T | 45 |
| 10250.022.1-T | 79 |
| 10847.027.1-B | 275 |
| 11100.032.1-D | 349 |
| 2035.016.1-B | 830 |
| 2039.032.1-F | 841 |
| 2186.001.2-F | 894 |
| 2186.009.1-T | 895 |
| 2186.036.1-F | 902 |
| 23039.000.5-X | 1043 |
| 23327.025.4-B | 1356 |
| 23476.017.1-T | 1445 |
| 26057.008.1-B | 1668 |
| 27102.014.1-T | 1782 |
| 27350.004.1-B | 1800 |
| 283846.001.1-B | 1833 |
| 440345.006.14-B | 2542 |
| 4784.014.1-T | 2698 |
| 54856.007.1-F | 3156 |
| 54856.029.1-T | 3158 |
| 54856.033.1-F | 3160 |
| 55249.001.3-T | 3278 |
| 57610.000.6-X | 3606 |
| 6229.003.1-C | 3826 |
| 65125.000.20-X | 3967 |
| 65125.010.1-F | 3972 |
| 65125.025.1-T | 3976 |
| 81608.009.1-F | 4810 |
| 8289.000.2-X | 4864 |
| 8289.004.1-T | 4865 |
| 8289.008.1-B | 4867 |
| 8289.009.1-F | 4869 |

Set 4 thus contains, for each identified sequence, 1 to 3 probes, overlapping or not, each comprising all or part of the sequence or its complementary sequence.

Distribution studies are shown in FIG. 6. They particularly show that set 1 composed of 6 probe groups (6 PS) such as defined above allows discriminating MCI and AD patients (FIG. 6B). They also show that all the 18 probe groups such as defined above can discriminate AD patients and controls, i.e., can identify those who have AD in a population of subjects (FIG. 6A).

EXAMPLE 6

Detection Protocol

The steps for the diagnostic test are the following:
The sample is prepared from an RNA extraction step from blood samples collected in Paxgene blood sample tubes. These tubes contain an additive that stabilizes the transcription profile for genes in vivo by reducing RNA degradation in vitro and by minimizing gene induction. When they are used with a Paxgene™ Blood RNA Kit, the samples taken allow detection and exact quantification of the gene transcription level. After extraction, a qualitative and quantitative RNA control step is performed.

The RNA is retrotranscribed, linearly amplified and then fragmented, labeled with biotin and finally hybridized on biochips containing the probes of the invention. The arrays are then washed and the hybridization is visualized and scanned to measure the hybridization level on each probe. The hybridization results are then imported into Partek analysis software.

The application of the signature gives a binary response that allows placing the patient tested in the AD or control category.

TABLE 3

| Collection of probe sets | Reference sequence (target sequence (SEQ ID)) | Specific probe (SEQ ID) |
|---|---|---|
| Set 3 | 67 | 5770 |
| | 67 | 5771 |
| | 67 | 5772 |
| | 568 | 7210 |
| | 568 | 7211 |
| | 568 | 7212 |
| | 573 | 7225 |
| | 573 | 7226 |
| | 573 | 7227 |
| | 1096 | 8726 |
| | 1096 | 8727 |
| | 1096 | 8728 |
| | 1724 | 10549 |
| | 1724 | 10550 |
| | 1724 | 10551 |
| | 2406 | 12505 |
| | 2406 | 12506 |
| | 2406 | 12507 |
| | 2590 | 13021 |
| | 2590 | 13022 |
| | 2590 | 13023 |
| | 3180 | 14704 |
| | 3180 | 14705 |
| | 3180 | 14706 |
| | 3288 | 15011 |
| | 3288 | 15012 |
| | 3288 | 15013 |
| | 3323 | 15113 |
| | 3323 | 15114 |
| | 3323 | 15115 |
| | 3325 | 15119 |
| | 3325 | 15120 |
| | 3325 | 15121 |
| | 3337 | 15153 |
| | 3337 | 15154 |
| | 3337 | 15155 |
| | 3408 | 15355 |
| | 3408 | 15356 |
| | 3408 | 15357 |
| | 3757 | 16359 |

TABLE 3-continued

| Collection of probe sets | Reference sequence (target sequence (SEQ ID)) | Specific probe (SEQ ID) |
|---|---|---|
| | 3757 | 16360 |
| | 3757 | 16361 |
| | 4178 | 17560 |
| | 4178 | 17561 |
| | 4178 | 17562 |
| | 4558 | 18636 |
| | 4558 | 18637 |
| | 4558 | 18638 |
| | 4735 | 19146 |
| | 4735 | 19147 |
| | 4735 | 19148 |
| | 5523 | 21401 |
| | 5523 | 21402 |
| | 5523 | 21403 |
| Set 2 | 53 | 5728 |
| | 53 | 5729 |
| | 53 | 5730 |
| | 613 | 7337 |
| | 613 | 7338 |
| | 613 | 7339 |
| | 697 | 7571 |
| | 697 | 7572 |
| | 697 | 7573 |
| | 709 | 7606 |
| | 709 | 7607 |
| | 1200 | 9033 |
| | 1200 | 9034 |
| | 1200 | 9035 |
| | 1205 | 9046 |
| | 1205 | 9047 |
| | 1205 | 9048 |
| | 1339 | 9433 |
| | 1339 | 9434 |
| | 1339 | 9435 |
| | 1846 | 10897 |
| | 1846 | 10898 |
| | 1846 | 10899 |
| | 2157 | 11798 |
| | 2157 | 11799 |
| | 2157 | 11800 |
| | 2289 | 12184 |
| | 2289 | 12185 |
| | 2289 | 12186 |
| | 2429 | 12573 |
| | 2429 | 12574 |
| | 2429 | 12575 |
| | 2600 | 13049 |
| | 2600 | 13050 |
| | 2600 | 13051 |
| | 2639 | 13160 |
| | 2642 | 13167 |
| | 2712 | 13369 |
| | 2712 | 13370 |
| | 2712 | 13371 |
| | 3503 | 15630 |
| | 3503 | 15631 |
| | 3636 | 16007 |
| | 3636 | 16008 |
| | 3636 | 16009 |
| | 3641 | 16022 |
| | 3641 | 16023 |
| | 3641 | 16024 |
| | 4529 | 18553 |
| | 4529 | 18554 |
| | 4671 | 18961 |
| | 4671 | 18962 |
| | 4671 | 18963 |
| | 5055 | 20051 |
| | 5055 | 20052 |
| | 5055 | 20053 |
| | 5219 | 20522 |
| | 5219 | 20523 |
| | 5219 | 20524 |
| | 5354 | 20912 |
| | 5354 | 20913 |
| | 5354 | 20914 |
| Set 4 | 42 | 5695 |
| | 42 | 5696 |
| | 42 | 5697 |
| | 45 | 5704 |
| | 45 | 5705 |
| | 45 | 5706 |
| | 79 | 5806 |
| | 79 | 5807 |
| | 79 | 5808 |
| | 275 | 6379 |
| | 275 | 6380 |
| | 275 | 6381 |
| | 349 | 6590 |
| | 349 | 6591 |
| | 349 | 6592 |
| | 830 | 7951 |
| | 830 | 7952 |
| | 830 | 7953 |
| | 841 | 7984 |
| | 841 | 7985 |
| | 841 | 7986 |
| | 894 | 8131 |
| | 894 | 8132 |
| | 894 | 8133 |
| | 895 | 8134 |
| | 895 | 8135 |
| | 895 | 8136 |
| | 902 | 8153 |
| | 902 | 8154 |
| | 902 | 8155 |
| | 1043 | 8568 |
| | 1043 | 8569 |
| | 1043 | 8570 |
| | 1356 | 9484 |
| | 1356 | 9485 |
| | 1356 | 9486 |
| | 1445 | 9746 |
| | 1445 | 9747 |
| | 1445 | 9748 |
| | 1668 | 10392 |
| | 1668 | 10393 |
| | 1668 | 10394 |
| | 1782 | 10714 |
| | 1782 | 10715 |
| | 1782 | 10716 |
| | 1800 | 10765 |
| | 1800 | 10766 |
| | 1800 | 10767 |
| | 1833 | 10859 |
| | 1833 | 10860 |
| | 2542 | 12889 |
| | 2542 | 12890 |
| | 2542 | 12891 |
| | 2698 | 13327 |
| | 2698 | 13328 |
| | 2698 | 13329 |
| | 3156 | 14634 |
| | 3156 | 14635 |
| | 3156 | 14636 |
| | 3158 | 14640 |
| | 3158 | 14641 |
| | 3158 | 14642 |
| | 3160 | 14646 |
| | 3160 | 14647 |
| | 3160 | 14648 |
| | 3278 | 14983 |
| | 3278 | 14984 |
| | 3278 | 14985 |
| | 3606 | 15919 |
| | 3606 | 15920 |
| | 3606 | 15921 |
| | 3826 | 16550 |
| | 3826 | 16551 |
| | 3826 | 16552 |
| | 3967 | 16956 |
| | 3967 | 16957 |

TABLE 3-continued

| Collection of probe sets | Reference sequence (target sequence (SEQ ID)) | Specific probe (SEQ ID) |
|---|---|---|
| | 3967 | 16958 |
| | 3972 | 16971 |
| | 3972 | 16972 |
| | 3972 | 16973 |
| | 3976 | 16983 |
| | 3976 | 16984 |
| | 3976 | 16985 |
| | 4810 | 19364 |
| | 4810 | 19365 |
| | 4810 | 19366 |
| | 4864 | 19519 |
| | 4864 | 19520 |
| | 4864 | 19521 |
| | 4865 | 19522 |
| | 4865 | 19523 |
| | 4865 | 19524 |
| | 4867 | 19528 |
| | 4867 | 19529 |
| | 4867 | 19530 |

TABLE 3-continued

| Collection of probe sets | Reference sequence (target sequence (SEQ ID)) | Specific probe (SEQ ID) |
|---|---|---|
| | 4869 | 19534 |
| | 4869 | 19535 |
| | 4869 | 19536 |
| Set 1 | 2363 | 12390 |
| | 2363 | 12391 |
| | 2363 | 12392 |
| | 2364 | 12393 |
| | 4218 | 17670 |
| | 5063 | 20074 |
| | 5063 | 20075 |
| | 5063 | 20076 |
| | 5307 | 20777 |
| | 5307 | 20778 |
| | 5307 | 20779 |
| | 5426 | 21121 |
| | 5426 | 21122 |
| | 5426 | 21123 |

SEQUENCE LISTING (51087 sequences)

SEQ ID NO: 1 - DNA, 36 bp, Homo sapiens
ccagggtgcaggaaaacagtaagtttggaaaaactg

SEQ ID NO: 2 - DNA, 36 bp, Homo sapiens
cagtgagcactgtgataggtgagattgcatagccat

SEQ ID NO: 3 - DNA, 262 bp, Homo sapiens
tgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctg

SEQ ID NO: 4 - DNA, 51 bp, Homo sapiens
ctccccctatgcctcagttgactccacagatacctctcacaggcttcgtgg

SEQ ID NO: 5 - DNA, 159 bp, Homo sapiens
cagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccac

SEQ ID NO: 6 - DNA, 45 bp, Homo sapiens
ctccttctggagctccaccagcaccacctctggcaccacttctcc

SEQ ID NO: 7 - DNA, 500 bp, Homo sapiens
ctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatt

SEQ ID NO: 8 - DNA, 309 bp, Homo sapiens
ctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtgg

SEQ ID NO: 9 - DNA, 327 bp, Homo sapiens
gctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaag

SEQ ID NO: 10 - DNA, 224 bp, Homo sapiens
gcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacag

SEQ ID NO: 11 - DNA, 132 bp, Homo sapiens
gctttagaggagaccaaagcctatacaacccaatctctagctagtgttgcttatcaaataaatgcattggccaacaatgtactccagttgctggatatccaagcctctcagcttcggagaatggagtcttcc

SEQ ID NO: 12 - DNA, 500 bp, Homo sapiens
gcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtgg

SEQ ID NO: 13 - DNA, 105 bp, Homo sapiens
aaccctggaacctgttaaacccccaacagttcctaatgactatatgaccagtcctgctaggcttggaagtcagcatagtccaggcaggacagcatctttaaatca

SEQ ID NO: 14 - DNA, 141 bp, Homo sapiens
ctggttcccagtatggcacaatgaccaggcagatatctcgacacaactctactacttcttcgacatcttctggtggatacagacgaactccctctgtgactgctcaattttctgctcagcctcatgttaatggaggtccac

SEQ ID NO: 15 - DNA, 36 bp, Homo sapiens
cccaacatccccactgaggcctccccgaagctgtcg

SEQ ID NO: 16 - DNA, 59 bp, Homo sapiens
gctcaagtgatccacctgcctcagcctcccagagtgctaggattacaggcgtgatctgc

SEQ ID NO: 17 - DNA, 36 bp, Homo sapiens
gcctcgacctctcaagtagctgggattacaagcacc

SEQ ID NO: 18 - DNA, 36 bp, Homo sapiens
ggcctcctgtcccgccagaagcctccaccatgccca

SEQ ID NO: 19 - DNA, 126 bp, Homo sapiens
atgaaagtagacaggactaaactgaagaagacacctactgaggctcctgcagactgcagagccttaatagacaaactcaaagtttgtaatgatgagcaacttctcttggaactgcagcagatcaaa

SEQ ID NO: 20 - DNA, 500 bp, Homo sapiens
aaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctac

SEQ ID NO: 21 - DNA, 36 bp, Homo sapiens
agctcacctgtgcagtaggtaggcgaggctcaggct

SEQ ID NO: 22 - DNA, 2290 bp, Homo sapiens
gaattccctcttaactcttgaagtaaataaataatctttgctggcaggactatgctgaatctccttaggcactctctaattagatgtcctaggtcctcccaattcttagtccttttatacctgtttttctccttctcttattccatttagtttttcaattcatacaaaactgtatccaggccatcacctatcattctatacaacaaatgtttcttctaacatccccacaatatcaccccttaccacaagacctcccttcagcttaatctctcccactctaggttcccacgctgcccctaatcccgcttgaagcagccctgagaaacatcgcccattctctctccataccaccccccaaaaattttcgccaccccaacacttcaacactattttatttttcttattaatataagaaggcaggcatgtcaggcctctgagcccaagccaagccatcgcaacccctgtgacttgcacctatacgcccagatggcctgaagtaactgaagaatcacaaaagaagtgaatatgccttgccccaccttaactgatgacattccaccacaaaagaagtgtaaatggccggtccttgccttaactgatgacattaccttgtgaaagtcctcttcctggctcatcctggctcaaaaagcacccccactgagcaccttgagacccccactcctgcccgccagagaacaaaccccctttgactgtaattttcctttacctacccaaatcctataaaacggccccacccttatctcccttcactgactctcttttcggactcagcccgcctgcacccaggtgaaataaacagctttattgctcacacaaagcctgtttggtggtctcttcacacggacgcacatgaaatttagttgtatccataaggcatatggaggagactaattcctcttccaaagacatgtaccagagtcctggagaggctgagggctggaggtggaagaaaggctctgacaggggtcagaatctgttcaggaaacatagcaaatgcctgatacttttaattagagaaaggtttgaatctccacattcatatatttgcagtccagtgacctttcagtttttttatgcccaaagtgtcaagcatgttaatgttaccattgactgcctccctgaaggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctacctcgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagatactgtcttgaatactattcctggtttctgaagaatgcaacatatatctgtcagagggtgaaaagggtgtcccactcgcacaccttaaagcaaaagtgccttgagaatatctgcaagtctgtgtgaggccttgaaaataacactagggcataacaattacttcaggggatacgccatccaccctggctcttgtcccaagtgggctacatttgaagaattcacccaggctccagctagatcatcagttaatttaaagtggttattcttggaagtagcattttttttccctctcctgtgaatctgtgcaaaacattgaaggtagaagttttcttgttaaaaaaaaaggaattc

SEQ ID NO: 23 - DNA, 36 bp, Homo sapiens
cacagattcagctcccaggtactgtatgaatgtata

SEQ ID NO: 24 - DNA, 36 bp, Homo sapiens
agcaaggctgtcatcacacctcacgattttgatgaa

SEQ ID NO: 25 - DNA, 128 bp, Homo sapiens
gggatgtcgaagaacacagtgtcgtcggcccgcttccggaaggtggacgtggatgaatatgacgagaacaagttcgtggacgaagaagatgggggcgacggccaggccgggcccgacgagggcgaggt

SEQ ID NO: 26 - DNA, 389 bp, Homo sapiens
gggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacacc

SEQ ID NO: 27 - DNA, 36 bp, Homo sapiens
gcacaagaacagcgtcagccagatctcggtgctcag

SEQ ID NO: 28 - DNA, 36 bp, Homo sapiens
agtatctgggatgtgaagagcttggagtcagccttg

SEQ ID NO: 29 - DNA, 82 bp, Homo sapiens
aggctggagtgtggtgacactaccttgactcactgcagcatctgcctcccgggttccagtgattctcctgcctcagcctctc

SEQ ID NO: 30 - DNA, 36 bp, Homo sapiens
aggtagctgggattacaggagccaagccgccatggc

SEQ ID NO: 31 - DNA, 424 bp, Homo sapiens
cggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaa

SEQ ID NO: 32 - DNA, 36 bp, Homo sapiens
agtttatcatcccttcctgtattgctattaaggagt

SEQ ID NO: 33 - DNA, 36 bp, Homo sapiens
actcatgtcattcctgtggtaaggctattttacagt

SEQ ID NO: 34 - DNA, 36 bp, Homo sapiens
atcttttttcatccagagtttgctaatccagacttt

SEQ ID NO: 35 - DNA, 441 bp, Homo sapiens
aggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcag

SEQ ID NO: 36 - DNA, 500 bp, Homo sapiens
ccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaa

SEQ ID NO: 37 - DNA, 500 bp, Homo sapiens
tgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatga

SEQ ID NO: 38 - DNA, 362 bp, Homo sapiens
ggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttct

SEQ ID NO: 39 - DNA, 500 bp, Homo sapiens
ctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcg

SEQ ID NO: 40 - DNA, 25 bp, Homo sapiens
tggcactcctccccttcctgctact

SEQ ID NO: 41 - DNA, 325 bp, Homo sapiens
gcccgtcttcgtgtctcctccctccctcgccttcctccttcctagctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccactt

SEQ ID NO: 42 - DNA, 36 bp, Homo sapiens
tccaccagcagaattcagttacccagtggacaacca

SEQ ID NO: 43 - DNA, 36 bp, Homo sapiens
ctggacccaaaagatccagtgtggtcagcccaagcc

SEQ ID NO: 44 - DNA, 500 bp, Homo sapiens
cttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttgg

SEQ ID NO: 45 - DNA, 500 bp, Homo sapiens
actcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggcccta

SEQ ID NO: 46 - DNA, 500 bp, Homo sapiens
ccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacc

SEQ ID NO: 47 - DNA, 500 bp, Homo sapiens
gtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctc

SEQ ID NO: 48 - DNA, 500 bp, Homo sapiens
tccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcc

SEQ ID NO: 49 - DNA, 500 bp, Homo sapiens
ttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttcta

SEQ ID NO: 50 - DNA, 36 bp, Homo sapiens
cgactgccgtcccccaagagctcgccggcgccccga

SEQ ID NO: 51 - DNA, 36 bp, Homo sapiens
gcagcggcccccggccggcccggcctcagcctggag

SEQ ID NO: 52 - DNA, 36 bp, Homo sapiens
gcagcggcccccggccggaccctagtgcctctaacg

SEQ ID NO: 53 - DNA, 311 bp, Homo sapiens
ccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctt

SEQ ID NO: 54 - DNA, 500 bp, Homo sapiens
cacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgcccc

SEQ ID NO: 55 - DNA, 500 bp, Homo sapiens
ctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccag

SEQ ID NO: 56 - DNA, 36 bp, Homo sapiens
gaagctgtgattgcccagatatccagtcatgttaaa

SEQ ID NO: 57 - DNA, 500 bp, Homo sapiens
caataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatg

SEQ ID NO: 58 - DNA, 36 bp, Homo sapiens
cgtgatccgctgtcctcggcctcccaaagtgctggg

SEQ ID NO: 59 - DNA, 230 bp, Homo sapiens
gcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatc

SEQ ID NO: 60 - DNA, 247 bp, Homo sapiens
tgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatc

SEQ ID NO: 61 - DNA, 248 bp, Homo sapiens
gcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtg

SEQ ID NO: 62 - DNA, 36 bp, Homo sapiens
aggctggagaaatccgagggtggcctttcagcagcc

SEQ ID NO: 63 - DNA, 36 bp, Homo sapiens
cctcccaggttcaagcgattctcatgccttagcctc

SEQ ID NO: 64 - DNA, 500 bp, Homo sapiens
ccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccc

SEQ ID NO: 65 - DNA, 500 bp, Homo sapiens
gagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaa

SEQ ID NO: 66 - DNA, 36 bp, Homo sapiens
tttctattcctgcctcagcttccccctataaccgct

SEQ ID NO: 67 - DNA, 36 bp, Homo sapiens
accaccaccacgacgaaggactccttctcctccccc

SEQ ID NO: 68 - DNA, 36 bp, Homo sapiens
acctaaaaagataaaaaaggctgcttccccaagccc

SEQ ID NO: 69 - DNA, 36 bp, Homo sapiens
gtctcgtagcccaagaagacgcaaatccagatctcc

SEQ ID NO: 70 - DNA, 36 bp, Homo sapiens
tcgatctccccgtcacagaaccaagagccggagtcc

SEQ ID NO: 71 - DNA, 500 bp, Homo sapiens
aaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccag

SEQ ID NO: 72 - DNA, 168 bp, Homo sapiens
ttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtaca

SEQ ID NO: 73 - DNA, 500 bp, Homo sapiens
tccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctc

SEQ ID NO: 74 - DNA, 317 bp, Homo sapiens
ggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgca

SEQ ID NO: 75 - DNA, 500 bp, Homo sapiens
ttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagac

SEQ ID NO: 76 - DNA, 500 bp, Homo sapiens
gcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgc

SEQ ID NO: 77 - DNA, 500 bp, Homo sapiens
atccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggc

SEQ ID NO: 78 - DNA, 239 bp, Homo sapiens
atccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccag

SEQ ID NO: 79 - DNA, 500 bp, Homo sapiens
ctgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaag

SEQ ID NO: 80 - DNA, 500 bp, Homo sapiens
aaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattct

SEQ ID NO: 81 - DNA, 51 bp, Homo sapiens
aaatggctgcagcagattctgtgcagcagagacgccaatacagacgacaaa

SEQ ID NO: 82 - DNA, 500 bp, Homo sapiens
ttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaag

SEQ ID NO: 83 - DNA, 500 bp, Homo sapiens
cctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagc

SEQ ID NO: 84 - DNA, 500 bp, Homo sapiens
acgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctg

SEQ ID NO: 85 - DNA, 429 bp, Homo sapiens
acgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccgga

SEQ ID NO: 86 - DNA, 160 bp, Homo sapiens
acagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccg

SEQ ID NO: 87 - DNA, 36 bp, Homo sapiens
atcagcaattggcaaaattgcagcagagaccgagag

SEQ ID NO: 88 - DNA, 500 bp, Homo sapiens
ctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtct

SEQ ID NO: 89 - DNA, 500 bp, Homo sapiens
tgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcagattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcct

SEQ ID NO: 90 - DNA, 36 bp, Homo sapiens
agcgacctgcaaccgacgattcttctactcaaaaca

SEQ ID NO: 91 - DNA, 500 bp, Homo sapiens
tttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataagga

SEQ ID NO: 92 - DNA, 435 bp, Homo sapiens
accttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttc

SEQ ID NO: 93 - DNA, 500 bp, Homo sapiens
ggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccg

SEQ ID NO: 94 - DNA, 496 bp, Homo sapiens
gtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccag

SEQ ID NO: 95 - DNA, 36 bp, Homo sapiens
tcgtcagcttgggaacagggaatcgctgtgtgaaag

SEQ ID NO: 96 - DNA, 500 bp, Homo sapiens
tttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatg

SEQ ID NO: 97 - DNA, 264 bp, Homo sapiens
ctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagag

SEQ ID NO: 98 - DNA, 332 bp, Homo sapiens
ccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagc

SEQ ID NO: 99 - DNA, 489 bp, Homo sapiens
gaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgca

SEQ ID NO: 100 - DNA, 500 bp, Homo sapiens
gccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcga

SEQ ID NO: 101 - DNA, 43 bp, Homo sapiens
gccttccagagacgctttgtggttgatgttcggcgctgtgagg

SEQ ID NO: 102 - DNA, 36 bp, Homo sapiens
cccactctccatcctcaggtgtttgacttcaccttt

SEQ ID NO: 103 - DNA, 36 bp, Homo sapiens
agctcagatcttgctcaggtgtttgacttcaccttt

SEQ ID NO: 104 - DNA, 36 bp, Homo sapiens
gagagctcttttgtgtttgttactagtacttggaat

SEQ ID NO: 105 - DNA, 36 bp, Homo sapiens
gagagctcttttgtgtttgatcaaatattgaagacc

SEQ ID NO: 106 - DNA, 36 bp, Homo sapiens
atgtcaatgctgccattgccaccatcaaaaccaagc

SEQ ID NO: 107 - DNA, 36 bp, Homo sapiens
aaccgccttattagccagattgtgtcctccatcact

SEQ ID NO: 108 - DNA, 497 bp, Homo sapiens
gctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagag

SEQ ID NO: 109 - DNA, 36 bp, Homo sapiens
ataaaagtggaaaatcaagatcatccttggaaaagg

SEQ ID NO: 110 - DNA, 500 bp, Homo sapiens
tgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcat

SEQ ID NO: 111 - DNA, 36 bp, Homo sapiens
aaggaagagaacagaaaggtaagcaccagccacaaa

SEQ ID NO: 112 - DNA, 500 bp, Homo sapiens
tgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggct

SEQ ID NO: 113 - DNA, 146 bp, Homo sapiens
ccagggatccctgctcagcattttcgtggagcccatttacttctcgagcatcatcctgggcagcctttaccacggggaccacctttccagggccatgtaccagcggatctccaacatagaggacctgccacctctctacaccctca

SEQ ID NO: 114 - DNA, 382 bp, Homo sapiens
gcccaggctggagtgcagtggtgcaatctctgctcactgcaacctccgtctcccgagttcaagcagttctcctgcctcagcctcctgagtagctgggattacaggtgcatgccatcatgcctagctaatttttgtattgttagtagagatggggtttcacgtgttagccaggatggtctggatctcctgacctcgtgatctgcctgcctcggcctcccaaagtgctgggattacaggtgtgagccactgcgcccagcctaattgccatgttggctaggctggcctcaatctcctggcctcaggtgatctggccaccttggtctcccaaagtgccgggactccgcctcccgggttcacaccattctcctgcctcagcctcccc

SEQ ID NO: 115 - DNA, 206 bp, Homo sapiens
caagcagtcctgctcctgatcccgcccctgaacctgatcctgcttctgctccagctccagcttcagctccagctcctgtcgtccctcagccttcaaaaatggctaagcctttggctatggctatccaacacttcagcctggttatcagaatgctacagcaccacttatttctggagtacagccccagtaacccggtatattctgga

SEQ ID NO: 116 - DNA, 499 bp, Homo sapiens
cctcatcaacaagaacacctcccactgcaaatcacccagttgagcctgtgacctcagttacacagccatcagagctattacaacaaaaaggcgtgcagtatggtgaatatgttaataaccaagctagctccgcaccaactcccttgtcatcaacttccgatgatgaggaagaggaggaggaggatgaggaagcaggtgttgacagctcttctaccacaagcagtgcttctccaatgcccaacagttatgatgccctggaaggaggcagttacccagatatgctttcttcatcagcaagcagtcctgctcctgatcccgcccctgaacctgatcctgcttctgctccagctccagcttcagctccagctcctgtcgtccctcagccttcaaaaatggctaagcctttggctatggctatccaacacttcagcctggttatcagaatgctacagcaccacttatttctggagtacagcccagtaacccggtatattctgga

SEQ ID NO: 117 - DNA, 500 bp, Homo sapiens
agctaagcttcctttaggattgttgttacatcccttcagagacctaacgcaattaccagtgataacatcaaataccattgtgaggtgccgatcctgtcgaacgtatattaacccctttgtatccttcattgatcaacgtagatggaaatgcaatttgtgctatagagtaaacgatgttcctgaagaatttatgtataacccccttacccgatcttatggagagcctcataaacgaccagaagttcagaattcaactgtggagttcattgcttcttcagattacatgctgcgtcctcctcaacctgcagtttacttgtttgttttagatgtgtctcataatgcagtggaagctggatatttgacaattttgtgccagtcactcctagaaaatctagacaagcttcctggagattcacgaacaagaataggattcatgacctttgatagcactattcatttctacaatttacaagaaggattatcacagcctcaaatgttga

SEQ ID NO: 118 - DNA, 36 bp, Homo sapiens
actccctgccgggtcagggttaaaaagatcaagtgg

SEQ ID NO: 119 - DNA, 57 bp, Homo sapiens
gtgcccaggctagtctcaaactcctgagctcaagcgatccaccctgccttggcctcc

SEQ ID NO: 120 - DNA, 36 bp, Homo sapiens
ccaccccagccttccaaagtgctgggattacaggca

SEQ ID NO: 121 - DNA, 36 bp, Homo sapiens
ttgtgtaccaggccatggaggaagttcagaagcaga

SEQ ID NO: 122 - DNA, 36 bp, Homo sapiens
aggaaaacagcctacccggtcctcttttcttcaata

SEQ ID NO: 123 - DNA, 216 bp, Homo sapiens
actttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgag

SEQ ID NO: 124 - DNA, 213 bp, Homo sapiens
agacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcag

SEQ ID NO: 125 - DNA, 56 bp, Homo sapiens
tgcccaggctggtttcaaacccctggcctcaagagattcttctgcctcgaccttcc

SEQ ID NO: 126 - DNA, 75 bp, Homo sapiens
cacagtggctcacacctgtaatcccggcactttgggaggcctgaggcgggtggatcatgaggtcaggagatcgag

SEQ ID NO: 127 - DNA, 36 bp, Homo sapiens
tcctcagaaccctgcccgaagcagcttagccgagta

SEQ ID NO: 128 - DNA, 107 bp, Homo sapiens
ccaccaattgcctttgatgttgaagcccccacgacgttaccgccctgcaagggaagctattttggaacagaaaacttgaagagtctggtcttgcacttcctgcaaca

SEQ ID NO: 129 - DNA, 36 bp, Homo sapiens
cccttttgcttcaagcaggtgagagcccaacatgga

SEQ ID NO: 130 - DNA, 496 bp, Homo sapiens
ctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggag

SEQ ID NO: 131 - DNA, 500 bp, Homo sapiens
ttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccacttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctac

SEQ ID NO: 132 - DNA, 500 bp, Homo sapiens
gaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgg

SEQ ID NO: 133 - DNA, 36 bp, Homo sapiens
ggagacgtgcagaaacatgcggagatggtccacaca

SEQ ID NO: 134 - DNA, 500 bp, Homo sapiens
tgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacg

SEQ ID NO: 135 - DNA, 36 bp, Homo sapiens
tttgagcctggtgaccagcctggcagtgagctggac

SEQ ID NO: 136 - DNA, 36 bp, Homo sapiens
tgttgccccggatttcaggcacctattaatgcacag

SEQ ID NO: 137 - DNA, 36 bp, Homo sapiens
tccatgggtcccgagcaggtgagtgcccaaggagaa

SEQ ID NO: 138 - DNA, 36 bp, Homo sapiens
gagggagacacaacacgggtaagaaagaacagtgaa

SEQ ID NO: 139 - DNA, 36 bp, Homo sapiens
gtcagatcaaagaacaagagaaagcagcagctgcca

SEQ ID NO: 140 - DNA, 36 bp, Homo sapiens
tcaaagaagaaggagaagatttgcagtcctgcttga

SEQ ID NO: 141 - DNA, 36 bp, Homo sapiens
ctcgccaggatctccaaggtaaatttcctctccaaa

SEQ ID NO: 142 - DNA, 112 bp, Homo sapiens
cattcagtcaaatctatcgtttttccttgtctgatggcactcttgttgctgcacaaacgaagagcaaactcatccgttctcagactactaatgaacctcaacttgtaatatc

SEQ ID NO: 143 - DNA, 500 bp, Homo sapiens
tgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtg

SEQ ID NO: 144 - DNA, 36 bp, Homo sapiens
cgtgaccgacccgagccgctccgacagagccgtgcg

SEQ ID NO: 145 - DNA, 500 bp, Homo sapiens
aaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcgga

SEQ ID NO: 146 - DNA, 500 bp, Homo sapiens
acatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaag

SEQ ID NO: 147 - DNA, 108 bp, Homo sapiens
ataccagcaccatgagagcagccatgaaaccaggctgggaggacctggtaagaaggtgtattcagaagttccatgcgcagcatgaaggagaatctgtgtcctatgcta

SEQ ID NO: 148 - DNA, 142 bp, Homo sapiens
atccaggctttactggggctacgactccccagagcccacttatgtcaccccgaatggcacatacacagagtcccatgatgcaacagtctcaggccaacccagcctatcaggccccctccgacataaatggatgggcgcaggg

SEQ ID NO: 149 - DNA, 54 bp, Homo sapiens
aggggaggcaacctgttcccaaaccagctgcctggaatggatatgattaagcag

SEQ ID NO: 150 - DNA, 36 bp, Homo sapiens
aggatgacgacaccctcagtaccagcagcgcggagg

SEQ ID NO: 151 - DNA, 36 bp, Homo sapiens
aaggggaaatcaaaacagacagagtgcctcaactac

SEQ ID NO: 152 - DNA, 291 bp, Homo sapiens
tctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatg

SEQ ID NO: 153 - DNA, 36 bp, Homo sapiens
atgcccacgggcccgcaggtgagcagggcctggccc

SEQ ID NO: 154 - DNA, 36 bp, Homo sapiens
tagcctcccgtgggctagatgtggaagatgtcaagt

SEQ ID NO: 155 - DNA, 200 bp, Homo sapiens
accaaatggggctacagagaagcatctaagccagttcacagagcgagcgtgtgtggggacttctcactgccacggacccttgatgcatgctccccgcgctccagtggtcccgtgtcagaaggcggagttttcgaaaggaggccgccaaaaataaaaggcaaagagacgggatcggctgcagcggtttcccaaaggaggag

SEQ ID NO: 156 - DNA, 270 bp, Homo sapiens
agccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaaga

SEQ ID NO: 157 - DNA, 36 bp, Homo sapiens
aagtagctgggactacaggtacgcctcacacttagc

SEQ ID NO: 158 - DNA, 36 bp, Homo sapiens
cctgccaggtggcgctcgatgaaattaaagcagaaa

SEQ ID NO: 159 - DNA, 36 bp, Homo sapiens
cacatggttgccgcccagcaagacacgctggatgca

SEQ ID NO: 160 - DNA, 36 bp, Homo sapiens
agattctcggagctgcagtggaggatgctggcgctg

SEQ ID NO: 161 - DNA, 87 bp, Homo sapiens
tgggcagtacatctctttttacatgaaacaaatcttcttcttggatgacagtgggccgccatttggccacatggtgctggccttggg

SEQ ID NO: 162 - DNA, 36 bp, Homo sapiens
tgtaaaggatcccaggaggcatgatgttgcagcccc

SEQ ID NO: 163 - DNA, 36 bp, Homo sapiens
tttacaagtggtgtcaaggcatcaataacctgcagg

SEQ ID NO: 164 - DNA, 36 bp, Homo sapiens
gttgagggacagcaggaagtatgtaaatggctccac

SEQ ID NO: 165 - DNA, 500 bp, Homo sapiens
gatattaacaagattatcatccggcagcctatccggactgagtacaagattgcttttccttacttgtacaacaatcttccacaccatgtccacctcacctggtaccatactcccaatgttgtattcatcaaaactgaagatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccc

SEQ ID NO: 166 - DNA, 251 bp, Homo sapiens
aagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagcc

SEQ ID NO: 167 - DNA, 36 bp, Homo sapiens
tgaggtcaggagtttgagatcagcctggccaacatg

SEQ ID NO: 168 - DNA, 192 bp, Homo sapiens
cacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacat

SEQ ID NO: 169 - DNA, 500 bp, Homo sapiens
aatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaat

SEQ ID NO: 170 - DNA, 96 bp, Homo sapiens
gaaagttatacatcgttggtggctctgatccatatggtcaaaaaggactgaaaaattgtgatgtatttgatcctgtaacaaagttgtggacaagct

SEQ ID NO: 171 - DNA, 182 bp, Homo sapiens
ttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaa

SEQ ID NO: 172 - DNA, 60 bp, Homo sapiens
atgttggccaggctggtctcaaactccttaactcaagtgatccgcctgcctcggcctccc

SEQ ID NO: 173 - DNA, 38 bp, Homo sapiens
gcactccggcctgggtgacagagcaagactccgtctca

SEQ ID NO: 174 - DNA, 30 bp, Homo sapiens
gcctgtctggataaagttgtcttgaaattt

SEQ ID NO: 175 - DNA, 481 bp, Homo sapiens
tcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctga

SEQ ID NO: 176 - DNA, 36 bp, Homo sapiens
gccccaacacaagctccagtcttcctcttcggcatg

SEQ ID NO: 177 - DNA, 271 bp, Homo sapiens
acaattcaccagaaatgaactgatgttgcatgtaggaacaccagaatacagtttttctaaaggattttgtggcacttttatgtatttcatgctattaatttcctgatgctgtttgaatgttttccccattgacccaaatatcagtgatgagttcataatgacatgcatttgttataatgaagcacctgtggtaaccagtgcaaggataatgattttattgaaacctagtttgataagaataaaagaaagataaggtaatgtccctaatgtt

SEQ ID NO: 178 - DNA, 36 bp, Homo sapiens
gaggagatgtaactatcggacctcggacagtgatcc

SEQ ID NO: 179 - DNA, 105 bp, Homo sapiens
tgtgaagattgctcctggagcagttgtatgtgtagaaagtgaaatcagaggagatgtaactatcggacctcggacagtgatccaccctaaagcaagaattattgc

SEQ ID NO: 180 - DNA, 263 bp, Homo sapiens
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaaca

SEQ ID NO: 181 - DNA, 198 bp, Homo sapiens
acgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatg

SEQ ID NO: 182 - DNA, 36 bp, Homo sapiens
agttttactgccttccagacaactatgagatcatcg

SEQ ID NO: 183 - DNA, 310 bp, Homo sapiens
aatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtg

SEQ ID NO: 184 - DNA, 36 bp, Homo sapiens
aacatccccattccccacctggtcctcccccttccc

SEQ ID NO: 185 - DNA, 500 bp, Homo sapiens
catgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggc

SEQ ID NO: 186 - DNA, 229 bp, Homo sapiens
gatttgagagtagacctttcatagtgaggcttatcaggttgaggggaggtgatgactggaaatatatttatttattttaaatcccactttggctttagtaaaatctgaatatgtgtgcatttctagtttcttacaccaaatgtaggttccgtaagttcatgcaagtacagtgggtcttggatcactgaagtctgaattttatattagcaactgaaaagtttactgtggc

SEQ ID NO: 187 - DNA, 36 bp, Homo sapiens
aatgatctcttttttcagccacctccactgactcct

SEQ ID NO: 188 - DNA, 500 bp, Homo sapiens
ttgtgagtttttttattttttattttttttaagctcatcaactatcattagtgtattttatgtgtggcccaagacagttcttccagtgtggcccagggaagccaaaagattggacaccccttgtaacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttccccattgtgtacagatgggagaatcctcagcacaagtgtctactactattggatggacagcggcagatgttcacagcgcgtcatgattaattagtttaaattgcaaggttctatctgtgaggtagctcaggtagatttaagggcggtagacatgaact

SEQ ID NO: 189 - DNA, 364 bp, Homo sapiens
gggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgc

SEQ ID NO: 190 - DNA, 36 bp, Homo sapiens
ctccctttcctcccctcctgcctcagcctcccaagt

SEQ ID NO: 191 - DNA, 352 bp, Homo sapiens
agccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaa

SEQ ID NO: 192 - DNA, 36 bp, Homo sapiens
gtatcagaaatctttttagggaagcaaaggcgaatg

SEQ ID NO: 193 - DNA, 503 bp, Homo sapiens
ggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaaccc

SEQ ID NO: 194 - DNA, 36 bp, Homo sapiens
agagggacaggaaaaagggtgcttacagcaaaggag

SEQ ID NO: 195 - DNA, 36 bp, Homo sapiens
aagcaaggcaaaggcaaaacttgtaaaaaaggcaaa

SEQ ID NO: 196 - DNA, 36 bp, Homo sapiens
ggcaagagtgctatgcagtcggtggtagatgattgg

SEQ ID NO: 197 - DNA, 36 bp, Homo sapiens
actgaagaattcgatgaggatagtggagattatcca

SEQ ID NO: 198 - DNA, 364 bp, Homo sapiens
gaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatg

SEQ ID NO: 199 - DNA, 424 bp, Homo sapiens
cactgcagaagattgtgaaaatgtctatcatctggtttattcagctcaccggccagtagcagtagcagctggagaatttctctacaaaaagctcttcagtcgtagagatccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagg

SEQ ID NO: 200 - DNA, 411 bp, Homo sapiens
aagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtca

SEQ ID NO: 201 - DNA, 366 bp, Homo sapiens
aagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaag

SEQ ID NO: 202 - DNA, 452 bp, Homo sapiens
cttgatattctgagtgaattttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatca

SEQ ID NO: 203 - DNA, 36 bp, Homo sapiens
tctatctgtctttgcaagcagtcttcaggttaaaga

SEQ ID NO: 204 - DNA, 129 bp, Homo sapiens
aagggcccagcagaaaagggcaaaggtggaaatggaggaggaaaacctccttctggtccaaaccgaatgaatggtcatcaccaacagaatggagtggaaaacatgatgttgtttgaagttgttaaaatg

SEQ ID NO: 205 - DNA, 500 bp, Homo sapiens
atagaatcatacaagcatgaccgagatatagcacttcttgaccttatcaacttttttattcagtgttcaggctgtaaaggagttgtcacagcagaaatgtttagacatatgcagaactctgagataattcgaaaaatgactgaagaattcgatgaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcagctatgaagttgatgacagctttggtgaatgtggcactaaatcttagcattaatatggataatacacaaagacaatatgaagcagaacggaataaaatgattggaaaacgagccaatgagaggctagaactcctgctaca

SEQ ID NO: 206 - DNA, 500 bp, Homo sapiens
catcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcagtcggtggtagatgattggatagaatcatacaagcatgaccgagatatagcacttcttgaccttatcaacttttttattc

SEQ ID NO: 207 - DNA, 169 bp, Homo sapiens
cttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgac

SEQ ID NO: 208 - DNA, 499 bp, Homo sapiens
tccagaggaggatggaatgatgaaaagaagaggaagacaaggtccaaatgccaaccttgttaagacattggtttttttctttctagaaagtgagttacatgagcatgcagcataccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaag

SEQ ID NO: 209 - DNA, 500 bp, Homo sapiens
taccttgtggatagcatgtgggactgtgctactgagctgctgaaagactgggaatgtatgaatagcttgttactggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcac

SEQ ID NO: 210 - DNA, 500 bp, Homo sapiens
aaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagagggtgaagaacctgatgaagatgatgcatatcaggtattgtcaacattgaagaggatcactgcttttcataatgcccatgacctttcaaagtgggatttatttgcttgtaattacaaactcttgaaaactggaatcgaaaatggagacatgcctgagcagattgttattcacgcactgcagtgtactcactatgtaatcctttggcaacttgctaagataactga

SEQ ID NO: 211 - DNA, 500 bp, Homo sapiens
tggaagagccacttagtggagaggaagcactaacagataggcaagagagtgctctgattgaaataatgctttgtaccattagacaagcggctgaatgtcatcctcccgtgggaagagggacaggaaaaagggtgcttacagcaaaggagaagaagacacagttggatgataggacaaaaatcactgagctttttgccgtggcccttcctcagttattagcaaaatactctgtagatgcagaaaaggtgactaacttgttgcagttgcctcagtactttgatttggaaatatataccactggacgattagaaaagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttctt

SEQ ID NO: 212 - DNA, 500 bp, Homo sapiens
gtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtggaagatgttatgatgtcctcagaagggaggattgaggatcttaatgagggaatggattttgacaccatggatatagatttgccaccatcaaagaacagacgagagagaacagaactgaagcctgatttctttgatccagcttcaattatggatgaatcagttcttggagtgtcaatgttttaataccagtacacaattaaatctgtggtgaagtcattttctaagtggaagaggaaattttaaagtgtggtagatacagtgaaattctgtacagatttttct

SEQ ID NO: 213 - DNA, 36 bp, Homo sapiens
aaccttttaacttccatgagccaccatgcccggccc

SEQ ID NO: 214 - DNA, 36 bp, Homo sapiens
gagccccgccgcgccgaggtgagggctggggaaggg

SEQ ID NO: 215 - DNA, 500 bp, Homo sapiens
gcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgc

SEQ ID NO: 216 - DNA, 36 bp, Homo sapiens
gagcccgcccgcgcgccgaggcatcccaacacgctg

SEQ ID NO: 217 - DNA, 36 bp, Homo sapiens
aaatcacagaaactcggagactctgagagtgtttcc

SEQ ID NO: 218 - DNA, 36 bp, Homo sapiens
ttcccttgatctactgccttatggattgaggtatat

SEQ ID NO: 219 - DNA, 36 bp, Homo sapiens
ccgaagcctcatgataaagaccaagaagctgataat

SEQ ID NO: 220 - DNA, 36 bp, Homo sapiens
ccgtggatgaagctgcatgtaagtccattcaaaatc

SEQ ID NO: 221 - DNA, 36 bp, Homo sapiens
gaaaatgcaagactgaagaatagctgtatttcagaa

SEQ ID NO: 222 - DNA, 500 bp, Homo sapiens
gacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaa

SEQ ID NO: 223 - DNA, 36 bp, Homo sapiens
gatgggttttatttccagacttcacttctaatgatg

SEQ ID NO: 224 - DNA, 36 bp, Homo sapiens
ttctatttttggtaataggacatctccaagtttgca

SEQ ID NO: 225 - DNA, 36 bp, Homo sapiens
aaaagaaatatttgaaagctgtgtctgtaaactgat

SEQ ID NO: 226 - DNA, 36 bp, Homo sapiens
tgtttttatatcttaaagctgtgtctgtaaactgat

SEQ ID NO: 227 - DNA, 36 bp, Homo sapiens
tgtcttgttccattccaggtggctgcttctttggtt

SEQ ID NO: 228 - DNA, 36 bp, Homo sapiens
tcatcttgtatattataggtgggattcttaatagat

SEQ ID NO: 229 - DNA, 36 bp, Homo sapiens
aacaactggaatctgaaggcaggagtccaattttca

SEQ ID NO: 230 - DNA, 36 bp, Homo sapiens
tatggaaatatttcacaggcaggagtccaattttca

SEQ ID NO: 231 - DNA, 36 bp, Homo sapiens
ctccaaactttttttcaggtgagaaggtggccaacc

SEQ ID NO: 232 - DNA, 36 bp, Homo sapiens
tttccattttaacaacaggagaaggagaaggaagag

SEQ ID NO: 233 - DNA, 36 bp, Homo sapiens
ttgttatttttatttcagatgcgatctgtgagccga

SEQ ID NO: 234 - DNA, 36 bp, Homo sapiens
tttggagtgataccacagaaagtatttattttttct

SEQ ID NO: 235 - DNA, 36 bp, Homo sapiens
tggaaagttgcagatgaggttgggctcagatctgtg

SEQ ID NO: 236 - DNA, 36 bp, Homo sapiens
attttctttcttttctagaacataccaaataattag

SEQ ID NO: 237 - DNA, 36 bp, Homo sapiens
atctgaaaaattggaaagagaatgggatagagagct

SEQ ID NO: 238 - DNA, 36 bp, Homo sapiens
atctttttatatttaggggtaaggatctcatttgta

SEQ ID NO: 239 - DNA, 36 bp, Homo sapiens
tgtgcttttattttccagggacttgcattggcacat

SEQ ID NO: 240 - DNA, 36 bp, Homo sapiens
gattgaaaacttaagacaaacagaactgaaactgac

SEQ ID NO: 241 - DNA, 36 bp, Homo sapiens
gcaataaacaaaatacaggatttcttacaaaagcaa

SEQ ID NO: 242 - DNA, 36 bp, Homo sapiens
tgtgtgtttttttaacagggatttggggaattattt

SEQ ID NO: 243 - DNA, 36 bp, Homo sapiens
acagccttctgggaggaggtcagaatttttaaaaaa

SEQ ID NO: 244 - DNA, 167 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgt

SEQ ID NO: 245 - DNA, 36 bp, Homo sapiens
ctccaaactttttttcagagaatgggatagagagct

SEQ ID NO: 246 - DNA, 167 bp, Homo sapiens; identical to SEQ ID NO: 244

SEQ ID NO: 247 - DNA, 36 bp, Homo sapiens
atctgaaaaattggaaaggaagtcaccaaagcagta

SEQ ID NO: 248 - DNA, 90 bp, Homo sapiens
gatcagtgaaagacttgtgattacctcagaaatgattgaaaatatccaatctgttaaggcatactgctgggaagaagcaatggaaaaaat

SEQ ID NO: 249 - DNA, 36 bp, Homo sapiens
aatgatgatgaagtacagaacagaactgaaactgac

SEQ ID NO: 250 - DNA, 36 bp, Homo sapiens
gattgaaaacttaagacagatttcttacaaaagcaa

SEQ ID NO: 251 - DNA, 51 bp, Homo sapiens
tgatttgtatttattagactctccttttggatacctagatgttttaacaga

SEQ ID NO: 252 - DNA, 36 bp, Homo sapiens
aaaagaaatatttgaaaggagtgcttttttgatgat

SEQ ID NO: 253 - DNA, 500 bp, Homo sapiens
atggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattgg

SEQ ID NO: 254 - DNA, 500 bp, Homo sapiens
gtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctga

SEQ ID NO: 255 - DNA, 36 bp, Homo sapiens
tcaacacgttgaaagcagttgttattaattgtgatt

SEQ ID NO: 256 - DNA, 500 bp, Homo sapiens
ccctcaggcaaacttgactgaactggatatatattcaagaaggttatctcaagaaactggcttggaaataagtgaagaaattaacgaagaagacttaaaggagtgcctttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccc

SEQ ID NO: 257 - DNA, 36 bp, Homo sapiens
aacaactggaatctgaaggagaaggagaaggaagag

SEQ ID NO: 258 - DNA, 54 bp, Homo sapiens
ggaacatttagaaaaaacttggatccctatgaacagtggagtgatcaagaaata

SEQ ID NO: 259 - DNA, 500 bp, Homo sapiens
ccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaata

SEQ ID NO: 260 - DNA, 310 bp, Homo sapiens
gtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccg

SEQ ID NO: 261 - DNA, 371 bp, Homo sapiens
gtctcttcttctggagcttcaatgggcttctattggtggttgacacaacaggaaaacctaacttcatctctcgctaccgaattcaggtcggcaagaatgaacctgtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaa

SEQ ID NO: 262 - DNA, 350 bp, Homo sapiens
cgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaacaaggaaactgaggccaggctccttcaccacccaacattctacaagaaaatccacaagaaacaccatgagtggacagctcccattggcgtgatctctctct

SEQ ID NO: 263 - DNA, 249 bp, Homo sapiens
cgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaa

SEQ ID NO: 264 - DNA, 36 bp, Homo sapiens
caagatgaaggtcaacaggatgctgcagccagtacc

SEQ ID NO: 265 - DNA, 36 bp, Homo sapiens
acgctggccacgacccaggtaaagacgcccattccc

SEQ ID NO: 266 - DNA, 500 bp, Homo sapiens
agcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggca

SEQ ID NO: 267 - DNA, 36 bp, Homo sapiens
ttctggctccttctccagctcctcctctggctcctc

SEQ ID NO: 268 - DNA, 102 bp, Homo sapiens
tttgatatgcccctggaggaaccttctagctcatccgtgccctctgcccctgaagaggaggaagagactgtggccagcaagcagactcatattctggagcag

SEQ ID NO: 269 - DNA, 500 bp, Homo sapiens
gtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccat

SEQ ID NO: 270 - DNA, 500 bp, Homo sapiens
tagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgccc

SEQ ID NO: 271 - DNA, 101 bp, Homo sapiens
ctgcgccgagttaaggtggatgttgagaagcagatgcccaaaaagtacgagcatgttatccgctgcaggctctccaagcgtcaacgctgtctctatgatga

SEQ ID NO: 272 - DNA, 151 bp, Homo sapiens
cacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacg

SEQ ID NO: 273 - DNA, 500 bp, Homo sapiens
ggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagt

SEQ ID NO: 274 - DNA, 500 bp, Homo sapiens
tcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaatgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatg

SEQ ID NO: 275 - DNA, 231 bp, Homo sapiens
ataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtc

SEQ ID NO: 276 - DNA, 500 bp, Homo sapiens
ggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactc

SEQ ID NO: 277 - DNA, 251 bp, Homo sapiens
acccaggctggagtgcagtggcatgatctcggctcactgcaacctccccctcccagattcaaacctcccagatcctcctgcctcagcctcccgagcggctgggattacaggcatgcgccaccacaactggctaatttttgtatttttagtagagatggggtttcaccatgttggctaggctggtcacgagctgctgacctcaagtgatctgccctcctcagcctcccaaagtgctgggattataggcctga

SEQ ID NO: 278 - DNA, 36 bp, Homo sapiens
cctccagatgcctcccagggtcaccttccagccctg

SEQ ID NO: 279 - DNA, 399 bp, Homo sapiens
gaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgt

SEQ ID NO: 280 - DNA, 273 bp, Homo sapiens
tgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagagg

SEQ ID NO: 281 - DNA, 500 bp, Homo sapiens
ccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccg

SEQ ID NO: 282 - DNA, 465 bp, Homo sapiens
cattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaag

SEQ ID NO: 283 - DNA, 500 bp, Homo sapiens
acagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacag

SEQ ID NO: 284 - DNA, 287 bp, Homo sapiens
gacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccag

SEQ ID NO: 285 - DNA, 58 bp, Homo sapiens
ttgcccaggctggtcttaaactttgagctcaggcagtccaccctcctcggcctcctaa

SEQ ID NO: 286 - DNA, 171 bp, Homo sapiens
agagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactgg

SEQ ID NO: 287 - DNA, 48 bp, Homo sapiens
agagaagacctcgtcccttcctagtcagggcatcagcatgactgagtg

SEQ ID NO: 288 - DNA, 500 bp, Homo sapiens
gtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttata

SEQ ID NO: 289 - DNA, 325 bp, Homo sapiens
gtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacatta

SEQ ID NO: 290 - DNA, 165 bp, Homo sapiens
ccatgctggagtgcagtggcgcgatctcggctcactgcaacctccgcctcccaagttgaagcaattctcctgcctcagcctcccgagtagctgggactacagatggagtcttgctctcttgcccaggctggaagtgcaatggtgtgatttccactcgctgcaacc

SEQ ID NO: 291 - DNA, 36 bp, Homo sapiens
gaagaaaagactgaagtgaaagaagaaccagagctt

SEQ ID NO: 292 - DNA, 500 bp, Homo sapiens
aggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaaga

SEQ ID NO: 293 - DNA, 137 bp, Homo sapiens
gagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacc

SEQ ID NO: 294 - DNA, 36 bp, Homo sapiens
atccacccaaaaattcaggaacaccagcctcgctcc

SEQ ID NO: 295 - DNA, 86 bp, Homo sapiens
acccaggctggagtgcaatggcatgatctcggctcactgcaaactccacctcccaggttcaattgattcttctgcctcagcctccc

SEQ ID NO: 296 - DNA, 36 bp, Homo sapiens
gagatgaagatgatgaagatggagatggcgatggag

SEQ ID NO: 297 - DNA, 500 bp, Homo sapiens
atggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtagg

SEQ ID NO: 298 - DNA, 36 bp, Homo sapiens
gataatgtggtcaaaaaggtccaagcagctcagtct

SEQ ID NO: 299 - DNA, 36 bp, Homo sapiens
ataccctgtcggtcccagcccctgcagttcagcctg

SEQ ID NO: 300 - DNA, 36 bp, Homo sapiens
cggctctgctctgcctcgggcccctccccaaaccca

SEQ ID NO: 301 - DNA, 36 bp, Homo sapiens
gttggattgggggtaataaacccggacggaagcgga

SEQ ID NO: 302 - DNA, 36 bp, Homo sapiens
tgtctttatggaaggaagccttttggccataaccag

SEQ ID NO: 303 - DNA, 36 bp, Homo sapiens
cagcacagacagacccaggtaggttggtgatcgata

SEQ ID NO: 304 - DNA, 65 bp, Homo sapiens
aaatgatggaagaattgcatagcctggacccacgacggcaggaattattggaggccaggtttact

SEQ ID NO: 305 - DNA, 47 bp, Homo sapiens
atagcctggacccacgacggcaggaattattggaggccaggtttact

SEQ ID NO: 306 - DNA, 36 bp, Homo sapiens
aagaacggcagattactgaggaagacttagagggca

SEQ ID NO: 307 - DNA, 36 bp, Homo sapiens
ggcgcctcctctccgtgggtaagctggtcactgtcc

SEQ ID NO: 308 - DNA, 155 bp, Homo sapiens
ctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgt

SEQ ID NO: 309 - DNA, 395 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttc

SEQ ID NO: 310 - DNA, 36 bp, Homo sapiens
acccgtcgccaggcatggacagcaggatcaagatca

SEQ ID NO: 311 - DNA, 500 bp, Homo sapiens
caaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttga

SEQ ID NO: 312 - DNA, 500 bp, Homo sapiens
aagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactg

SEQ ID NO: 313 - DNA, 500 bp, Homo sapiens
tgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagata

SEQ ID NO: 314 - DNA, 36 bp, Homo sapiens
ggattgggagaaaaggagctactggtgctactacaa

SEQ ID NO: 315 - DNA, 385 bp, Homo sapiens
gtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccg

SEQ ID NO: 316 - DNA, 236 bp, Homo sapiens
aaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtc

SEQ ID NO: 317 - DNA, 500 bp, Homo sapiens
ttacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatc

SEQ ID NO: 318 - DNA, 36 bp, Homo sapiens
ttctcctttgttttttagctggacagactccaccac

SEQ ID NO: 319 - DNA, 36 bp, Homo sapiens
tgtctgatgccagtgctggtgattatgggagtgcta

SEQ ID NO: 320 - DNA, 36 bp, Homo sapiens
tgtctgatgccagtgctggtttgtgtatttcttgta

SEQ ID NO: 321 - DNA, 500 bp, Homo sapiens
gtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatact

SEQ ID NO: 322 - DNA, 500 bp, Homo sapiens
tggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccac

SEQ ID NO: 323 - DNA, 500 bp, Homo sapiens
tgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggacca

SEQ ID NO: 324 - DNA, 500 bp, Homo sapiens
ccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtc

SEQ ID NO: 325 - DNA, 79 bp, Homo sapiens
ttggccagtatggtctcgatctcctgacctcgtgattcacccaccttgggctcccaaagtgctgggattacagatgtga

SEQ ID NO: 326 - DNA, 36 bp, Homo sapiens
aacagtacctggcacagggtaagcacaatagatttg

SEQ ID NO: 327 - DNA, 132 bp, Homo sapiens
tctgccctggaattgccaatcacagcgagaagcaatacatccgcactttcgttgactacgcccagaaaaatggctatcggtgcgccgtgctgaaccacctgggtgccctgcccaacattgaattgacctcgc

SEQ ID NO: 328 - DNA, 36 bp, Homo sapiens
ccctgttttgtttcctaggatgatggcttggaaaaa

SEQ ID NO: 329 - DNA, 36 bp, Homo sapiens
gactgggaaagaaaggagccactggagcatctacta

SEQ ID NO: 330 - DNA, 500 bp, Homo sapiens
tcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttgg

SEQ ID NO: 331 - DNA, 36 bp, Homo sapiens
tgatggagaaaaactcagtcactcagcctctgaaga

SEQ ID NO: 332 - DNA, 105 bp, Homo sapiens
tgttaaaaagcagccgaagactcagcgtggaaagagaaaaaagcaagattcttctgatgaggatgatgatgatgacgaagctcccaaaaggcagactcgtcgaag

SEQ ID NO: 333 - DNA, 500 bp, Homo sapiens
attcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagagg

SEQ ID NO: 334 - DNA, 500 bp, Homo sapiens
aactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaag

SEQ ID NO: 335 - DNA, 500 bp, Homo sapiens
ttttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggtt

SEQ ID NO: 336 - DNA, 99 bp, Homo sapiens
aaatcttcgagtaaatcaaagcgatctcagggtcctgtccatattacagcaggaagtgaacctgtccccattggagaggatgaggatgatgatctggac

SEQ ID NO: 337 - DNA, 500 bp, Homo sapiens
atagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacag

SEQ ID NO: 338 - DNA, 36 bp, Homo sapiens
ctcgggaggctgaggcaggagaatcacttgaacctg

SEQ ID NO: 339 - DNA, 27 bp, Homo sapiens
cccagcactttgggaggctgaggcagg

SEQ ID NO: 340 - DNA, 500 bp, Homo sapiens
gaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcc

SEQ ID NO: 341 - DNA, 254 bp, Homo sapiens
aagtttaagacttcgcgagaacagaatttcttttggcacctcctctccgcgcgttcttggggctggagtgcagtggcacgatcttggctcactgaaacctcagcctcccaggttcaagagattctcccacctcagcctctggagtagctgggatcacagagtctctgttgcccaggctggaatgcaatggtgcgatctcagtcactacaacctctgcctcccgggttcaagcgattatcctgcttcagcctccc

SEQ ID NO: 342 - DNA, 500 bp, Homo sapiens
attctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctt

SEQ ID NO: 343 - DNA, 36 bp, Homo sapiens
agctacagccctccacagccgagttacagccagcca

SEQ ID NO: 344 - DNA, 36 bp, Homo sapiens
ttgttgctattgacacctataactgcgacctccact

SEQ ID NO: 345 - DNA, 500 bp, Homo sapiens
tgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagc

SEQ ID NO: 346 - DNA, 36 bp, Homo sapiens
attgagctgcagcgggaggaagcggacaagctagtg

SEQ ID NO: 347 - DNA, 117 bp, Homo sapiens
actaccgaggaggtttcaaccgcagcggaggtggtggctatagccagaaccgctggggtaacaacaaccgggataacaacaactccaacaacagaggcagctacaaccgggctcccc

SEQ ID NO: 348 - DNA, 82 bp, Homo sapiens
caccacccagctacagccctgctcggaaccccccaggggccagcacctacaataagaacagcaacatccctggctcaagcgc

SEQ ID NO: 349 - DNA, 36 bp, Homo sapiens
caataccagcacccccaccgtcagcagctacagccc

SEQ ID NO: 350 - DNA, 280 bp, Homo sapiens
ccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccag

SEQ ID NO: 351 - DNA, 106 bp, Homo sapiens
ccacagccaccaccccagcagccaccgccaccacccagctacagccctgctcggaaccccccaggggccagcacctacaataagaacagcaacatccctggctcaa

SEQ ID NO: 352 - DNA, 25 bp, Homo sapiens
aaccgggctccccagcaacagccgc

SEQ ID NO: 353 - DNA, 231 bp, Homo sapiens
gacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaag

SEQ ID NO: 354 - DNA, 36 bp, Homo sapiens
gtgccatccctgccccaggcctcccagtggcaattc

SEQ ID NO: 355 - DNA, 438 bp, Homo sapiens
gcctgtagtcccagctacttaggaggctgagagaggaggatcgcgtgaacctggaagtttgaggctgtagtgagctatgattgcaccagtgcactccagcttggatgacagaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttc

SEQ ID NO: 356 - DNA, 310 bp, Homo sapiens
ttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctg

SEQ ID NO: 357 - DNA, 87 bp, Homo sapiens
tgccgaggctggagtgccgtgatgtgatcttggctcactgcaacctctgcctccaaggttcaagtgattctcctgccacagcttcct

SEQ ID NO: 358 - DNA, 26 bp, Homo sapiens
cggcgattcaaagttagtcaggtaat

SEQ ID NO: 359 - DNA, 36 bp, Homo sapiens
agttagtcaggtaatcatggaaaagtctacaatgtt

SEQ ID NO: 360 - DNA, 25 bp, Homo sapiens
cagaaaaacaagtagaaactgagga

SEQ ID NO: 361 - DNA, 500 bp, Homo sapiens
gacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaa

SEQ ID NO: 362 - DNA, 36 bp, Homo sapiens
ccactgcccaccctggccgacagcctccttcagccc

SEQ ID NO: 363 - DNA, 36 bp, Homo sapiens
tcacttttttgtctttgggaaaccacaggaacaatt

SEQ ID NO: 364 - DNA, 500 bp, Homo sapiens
gtgggaagaggatgaagcaatttccagaagtgatcaagtacctgagccgcaacctggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtctgactactatccaagggcaggccagaaataagcggaaacaagagaccaagagcttaaagcacaaggaa

SEQ ID NO: 365 - DNA, 281 bp, Homo sapiens
atgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaa

SEQ ID NO: 366 - DNA, 500 bp, Homo sapiens
gtgtgttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcatcttttcagcaggaactccctctcttctcggtagctttgaatcttaagcttctacgggagagtggtagaactggatcatttcataatcccatttagttgtgcttttcttcatatacttcataccccaggaccccttccccagcagcagagaccctggagcacaggagagtagggaggaggggttctgggtccatcactgccttacatgtgactatgtccaagttaagcccccaacacgagaggaaagctgctgactcccagctatagccatgggcacttggccccctgcttttcctgctcagcagagccc

SEQ ID NO: 367 - DNA, 36 bp, Homo sapiens
acattaggagccatcaaggttacagatcgacatatc

SEQ ID NO: 368 - DNA, 60 bp, Homo sapiens
atgaagatgcagaccccacaaaatctgcactgtctgcagttgcatctttggcagctgcat

SEQ ID NO: 369 - DNA, 62 bp, Homo sapiens
tccatgctctctgtggaaagctactgaccctagtttcaactagggattttattgaagattat

SEQ ID NO: 370 - DNA, 80 bp, Homo sapiens
gctggagtgcagtggcacggtctcggctccctgcaacctccgcctcccaggttcaagtgattctcctgcctcagcctccg

SEQ ID NO: 371 - DNA, 36 bp, Homo sapiens
tgtccctctacgcccttggcctcctgctgccgtggc

SEQ ID NO: 372 - DNA, 36 bp, Homo sapiens
cccacccctcgcccccaggcctcctgctgccgtggc

SEQ ID NO: 373 - DNA, 36 bp, Homo sapiens
gaagcacgagatgaaatgggattgtcatcagaccca

SEQ ID NO: 374 - DNA, 500 bp, Homo sapiens
aaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaagga

SEQ ID NO: 375 - DNA, 500 bp, Homo sapiens
cttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtat

SEQ ID NO: 376 - DNA, 500 bp, Homo sapiens
agctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagac

SEQ ID NO: 377 - DNA, 500 bp, Homo sapiens
ggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcc

SEQ ID NO: 378 - DNA, 36 bp, Homo sapiens
acaagaccttcggccctggaggcctccaaggggaca

SEQ ID NO: 379 - DNA, 36 bp, Homo sapiens
atatgcctgtgcccgcaggcccgcagccttcaggcc

SEQ ID NO: 380 - DNA, 36 bp, Homo sapiens
gacctctatgctgagcagatggaacgagaaatgagg

SEQ ID NO: 381 - DNA, 36 bp, Homo sapiens
gtaaatgctacggaatgggtgagtgtttcttacttt

SEQ ID NO: 382 - DNA, 36 bp, Homo sapiens
aggaagaagcccgaaaagcggaccgagaaagtcgtt

SEQ ID NO: 383 - DNA, 36 bp, Homo sapiens
gcctgttcctgagtttgagtgccgaccaacccccag

SEQ ID NO: 384 - DNA, 390 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagct

SEQ ID NO: 385 - DNA, 36 bp, Homo sapiens
tcattatgagaaacaagccctcacagcccaaggagc

SEQ ID NO: 386 - DNA, 36 bp, Homo sapiens
attttgttcctttggcagcaggttgtccagagcgtt

SEQ ID NO: 387 - DNA, 36 bp, Homo sapiens
ctcctcagcgctctgcaggtgcgtgccttcatcttc

SEQ ID NO: 388 - DNA, 36 bp, Homo sapiens
tttctcccccatttacagatgctggcccgcgagaga

SEQ ID NO: 389 - DNA, 500 bp, Homo sapiens
cagagcccagaatgtgagaacttcctggatgttggactgggcagagagtgtacctcaaaacaaggtgtacttaaaagagaatctgggagtgattctgacctctttcactcacccagtgatgacatggacagcatcatcttcccaaagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgc

SEQ ID NO: 390 - DNA, 107 bp, Homo sapiens
ttaatccacagcaagctcccttatatggtgattgtgttgttacagtgctgcttgctgaagaggacaaagctgaagatgatgtagtgttttacttggtatttttgggt

SEQ ID NO: 391 - DNA, 500 bp, Homo sapiens
acaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaa

SEQ ID NO: 392 - DNA, 500 bp, Homo sapiens
agattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacag

SEQ ID NO: 393 - DNA, 36 bp, Homo sapiens
aatggagtcgttgggaatgaagctgcagtaaaggaa

SEQ ID NO: 394 - DNA, 106 bp, Homo sapiens
cccaggctggtcttgaacttgcttcaagtcatcctcccgcttcagccccccgagtagctggccttacagacttgagccactgtgtcaggatggatttttgaaattt

SEQ ID NO: 395 - DNA, 500 bp, Homo sapiens
ttggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctaga

SEQ ID NO: 396 - DNA, 500 bp, Homo sapiens
gagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttctt

SEQ ID NO: 397 - DNA, 36 bp, Homo sapiens
gcctcccaagtagctgggactacaggcatgagccac

SEQ ID NO: 398 - DNA, 36 bp, Homo sapiens
gcctcccaaagtgctgggactacaggcatgagccac

SEQ ID NO: 399 - DNA, 36 bp, Homo sapiens
gcctcccaagtagctgggattacaggcgcatgccac

SEQ ID NO: 400 - DNA, 42 bp, Homo sapiens
ttggaaagaggcaggtacggaagctgagctgcagagttagcc

SEQ ID NO: 401 - DNA, 25 bp, Homo sapiens
tttgggaggccaaggcaggtggatc

SEQ ID NO: 402 - DNA, 36 bp, Homo sapiens
tcctgggttcaagcaattctcccacctcagcctccc

SEQ ID NO: 403 - DNA, 36 bp, Homo sapiens
tcctgacctcaggtgatcctcctgcctcggcctccc

SEQ ID NO: 404 - DNA, 155 bp, Homo sapiens
atgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctccccca

SEQ ID NO: 405 - DNA, 36 bp, Homo sapiens
gcccactacccctcacagccggtgtttgcccccatg

SEQ ID NO: 406 - DNA, 373 bp, Homo sapiens
gcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagccta

SEQ ID NO: 407 - DNA, 36 bp, Homo sapiens
acctaccctgcaaatcaggtagtaaagccagaagaa

SEQ ID NO: 408 - DNA, 83 bp, Homo sapiens
gccacttcctggaactaaagcattgccttcaatggacaaatatgctgtgtttaaaggaattgcagctgacaagtcctctgaaa

SEQ ID NO: 409 - DNA, 467 bp, Homo sapiens
aacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctg

SEQ ID NO: 410 - DNA, 36 bp, Homo sapiens
gcaccttccccttccgagccactcaagccacagtgg

SEQ ID NO: 411 - DNA, 36 bp, Homo sapiens
acttttctttgcacatagatggcaagatctttcagg

SEQ ID NO: 412 - DNA, 36 bp, Homo sapiens
ctactgtgtgtgattcagctggcggaggcagtgacc

SEQ ID NO: 413 - DNA, 36 bp, Homo sapiens
gtcatgaggcgagctgggattaaggtcaccgttgca

SEQ ID NO: 414 - DNA, 52 bp, Homo sapiens
gccccaggcggtgcttctccccaccaccgcccagctcagctcagcccagccc

SEQ ID NO: 415 - DNA, 132 bp, Homo sapiens
gccccaggcggtgcttctccccaccaccgcccagctcagctcagcccagcccagcccactctgcccttagaggcccttctccccaaagacgcactccagaagtctcgccctcgtgcggctgaggagcctggg

SEQ ID NO: 416 - DNA, 500 bp, Homo sapiens
caatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggc

SEQ ID NO: 417 - DNA, 500 bp, Homo sapiens
aatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctt

SEQ ID NO: 418 - DNA, 500 bp, Homo sapiens
accaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggt

SEQ ID NO: 419 - DNA, 31 bp, Homo sapiens
tcaagcgattctcctgtctcagcctcctgag

SEQ ID NO: 420 - DNA, 225 bp, Homo sapiens
cgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttg

SEQ ID NO: 421 - DNA, 68 bp, Homo sapiens
ttgcttaggctagtctcaaactcctgggctcaagcagtccttcagccttggcctcccaaagcactgga

SEQ ID NO: 422 - DNA, 36 bp, Homo sapiens
aacgcccagggccgcaaggtgagtgccaccatgcgc

SEQ ID NO: 423 - DNA, 36 bp, Homo sapiens
ttgtcctcctcagcctcggtgccttggaatttgtgt

SEQ ID NO: 424 - DNA, 500 bp, Homo sapiens
aggctggtgtccaatggcacaatcttggctcactgcaaccgctgcctcccgggttcaagcaattctcctcgctcagcctcccaagtagctggggttacaggcaggtgccagcatgcctggctaatttttctatttttagtagagaggggtttcaccatgttggccaggctggtcttgaactcctgagctcaagtgatctgcctgcctcggcttcccaaagtgcttggattacaggcatgagctaccgtccccagcctatattgtttattatatatcatatgatatatatattgctgatacatataccatatatattattacagatataatctgttatatatatatcagttatatatacacattagatgaaaagttgtatgtatatatacacattagatgaaaagtacattttcattttacagggaattctttcaaatctaatcatcaaaaactttaaaattgggcaaagtacttttttccagatctgcaagttatttgtg

SEQ ID NO: 425 - DNA, 500 bp, Homo sapiens
acacctacaactgtagcacaggctataattaaatatatagactttacaaaatactccagtaatcagagttgaaggaagtaaaatttaatactttacttacttttttgcctttattaaaggcatttaagttttttagcggatgttaatgtttacaaatgtcaccacaatacaggtaatttccaatttgaagtgtagttgcttgcaaaagtatatctgacagacattttcaatgtattttctagaaggaacacattatattttgttttgagacggagtctcattctgtcgcccaggctggagtgcagtggcacagtcttggctcattgcaacctccgcctcccagattcaagcagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcg

SEQ ID NO: 426 - DNA, 67 bp, Homo sapiens
acacaagaagggtaggagagaaaagccatggccgacaaggtcctgaaggagaagagaaagctgttta

SEQ ID NO: 427 - DNA, 36 bp, Homo sapiens
aggggaccggccatcgtgccacctgtttttcatgaa

SEQ ID NO: 428 - DNA, 36 bp, Homo sapiens
gccgaaccatgggccgcggtgtgggctaagctggtg

SEQ ID NO: 429 - DNA, 36 bp, Homo sapiens
ggatgtctgtgttatcaggcacgcgggagctgatta

SEQ ID NO: 430 - DNA, 36 bp, Homo sapiens
gagagcggatcacttgaggtgtgggctaagctggtg

SEQ ID NO: 431 - DNA, 151 bp, Homo sapiens
gaattcacactcttggtgtgaaaaagcaggagtaaaacttgggagtagtggctgaataaattggggaagaaagtctttggccactggataaagcctaaagagaatagtaggtctgctcagcctaattggtttgcctagggagagacccctg

SEQ ID NO: 432 - DNA, 36 bp, Homo sapiens
ccttccagagggccgctggtggcagccgagtacagg

SEQ ID NO: 433 - DNA, 36 bp, Homo sapiens
tcaccaagaactcgggagacatcaccacggagctgg

SEQ ID NO: 434 - DNA, 36 bp, Homo sapiens
tcaccaagaactcgggaggtgaggcccagtccccag

SEQ ID NO: 435 - DNA, 36 bp, Homo sapiens
caaggccatgatcaaaacgtatgtggtgccaagctc

SEQ ID NO: 436 - DNA, 75 bp, Homo sapiens
ggctccccttcccagtatgggatggccggctcctatggctcagccacaccccagcagccatccgcaccccaacac

SEQ ID NO: 437 - DNA, 437 bp, Homo sapiens
gggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaag

SEQ ID NO: 438 - DNA, 125 bp, Homo sapiens
tttcttctgatttttttttcccctttccctccctccctctccgcattcttcccttggttcagcacaggtaaaacggttcccctccctccctgccttcatggatcaccagctcacgtcatgttgcc

SEQ ID NO: 439 - DNA, 500 bp, Homo sapiens
ccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactg

SEQ ID NO: 440 - DNA, 500 bp, Homo sapiens
cctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggc

SEQ ID NO: 441 - DNA, 160 bp, Homo sapiens
ggccaggatggagtgcagtggcatgatctcggctcactgcagcctccaccacccgagttcaagtgattctcctgcctcaccctcccgagtagttgggattacagccatgcactaccatgcccggctaatttttgtatttttagtagagacggggtttcac

SEQ ID NO: 442 - DNA, 36 bp, Homo sapiens
gctgtggctcacgcctgtaatcccagctctttggag

SEQ ID NO: 443 - DNA, 61 bp, Homo sapiens
aatctccgctcactgcaacctctgcctcccggttcaagcgattctcctgcctcagcctcct

SEQ ID NO: 444 - DNA, 36 bp, Homo sapiens
tgttgctgttgatctgtggtgagttgggcaactcag

SEQ ID NO: 445 - DNA, 500 bp, Homo sapiens
atatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaag

SEQ ID NO: 446 - DNA, 500 bp, Homo sapiens
tgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtact

SEQ ID NO: 447 - DNA, 36 bp, Homo sapiens
tgttgctgttgatctgtgagctgtttttgatagcca

SEQ ID NO: 448 - DNA, 60 bp, Homo sapiens
ctctaggtaccatccctgacctggtcctcatgctgccgaggctgttgctgttgatctgtg

SEQ ID NO: 449 - DNA, 93 bp, Homo sapiens
gaagacgttcagccagggatccactcaggagccttcccagccctctaccccaagagttcacctacctcaactcacctaccccagggcagctac

SEQ ID NO: 450 - DNA, 393 bp, Homo sapiens
ttgccccagctgaagtgcagtggtatggtcatggctcattgcaaccttgaattcctggtctcaagtgatgcacctgcctcagctccctgagtagctggaaccagagacacatgcaaccacactcagctaattaaaacaattttttgaccaggcttatctcaaacttctggcccccatcaatcctcccacctcagccttccaaagtgttgggattacagtcataagccactgcatctggcttggatcttttgctgacctcaaaatgttggacatcctcaaagttgatacctagacttcatccatactcacttccccaaattatataattatgtcacttcatgtgccactttaagcttaaatgcaagcttatttctccagctttcacctctcttt

SEQ ID NO: 451 - DNA, 61 bp, Homo sapiens
tttttttgatgagaggcatctctaggtaccatccctgacctggtcctcatgctgccgaggc

SEQ ID NO: 452 - DNA, 500 bp, Homo sapiens
gcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgcca

SEQ ID NO: 453 - DNA, 500 bp, Homo sapiens
ttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacg

SEQ ID NO: 454 - DNA, 47 bp, Homo sapiens
accccaagagttcacctacctcaactcacctaccccagggcagctac

SEQ ID NO: 455 - DNA, 500 bp, Homo sapiens
cactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctac

SEQ ID NO: 456 - DNA, 500 bp, Homo sapiens
tgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccgg

SEQ ID NO: 457 - DNA, 36 bp, Homo sapiens
ctgcaacctccgcctcccgagaatctcttgaacccg

SEQ ID NO: 458 - DNA, 36 bp, Homo sapiens
gacaccctgacccctgaggttcgcctttggcttcac

SEQ ID NO: 459 - DNA, 36 bp, Homo sapiens
actacacggtgtttgactattgaaaaggccaaacct

SEQ ID NO: 460 - DNA, 36 bp, Homo sapiens
cagtttttgaagaccaagccaccattggcgcctgga

SEQ ID NO: 461 - DNA, 162 bp, Homo sapiens
agggcatggctcatgcaatcaccagctaagaaaggaactgagacttctcttcatttgttgttttttccttccccacctttccctagaaactattagactgccacactgtcccgttgtgtgacacgggacactttaagtgacggggtagacaaaagctggaac

SEQ ID NO: 462 - DNA, 110 bp, Homo sapiens
tttacctaagcaagcctgggcaatggcgggcgtccctcccccagcctcgttgccgccttgcagtttgatctcagactgctgtgctagcaatcagcgagattccgtgggcg

SEQ ID NO: 463 - DNA, 36 bp, Homo sapiens
tgcctattgaggacccagcgaaacatcggatactgg

SEQ ID NO: 464 - DNA, 36 bp, Homo sapiens
tgctgcgccagggggatggagtggacctggttccaa

SEQ ID NO: 465 - DNA, 36 bp, Homo sapiens
agcacactgacagttcagatgtgtcgaccctgcaga

SEQ ID NO: 466 - DNA, 86 bp, Homo sapiens
gcccaggctggagtgcagtggtgcgatctcggctctctgcaacctccgcctcccaggttcaagtgattctcctgcctcggcctcct

SEQ ID NO: 467 - DNA, 36 bp, Homo sapiens
aagtagctgggattacaggcacccaccaccatgccc

SEQ ID NO: 468 - DNA, 98 bp, Homo sapiens
ggaggacatcatggtgcgggatgttccccatgtggccctcagctgcaccttccgggacctgcgtttggcactgcacaggaccaagggccgaatgctgg

SEQ ID NO: 469 - DNA, 289 bp, Homo sapiens
catgcaaccacacctggctaattttcttttcttctttctttcttttttttttttttttttttttgatggagtcttgttctgttgcccaggctggagtgcaatggtgcaatcttggctcactgcaacctctgcctcctgggttcaatccattctcctgcctcagcctcccaagtagctgggattacaggcacatgcctccataccgggctaatttttgtatttttagtagagatggggtttcgccatgtgggccaggctgttctcgaatgcctgacctcaggtgatccac

SEQ ID NO: 470 - DNA, 96 bp, Homo sapiens
gttcttaagggttcagagcagccagattccagcagtgcccggtaacactacacacaagaagtattactctggtccagcaaataatttgtctatttc

SEQ ID NO: 471 - DNA, 36 bp, Homo sapiens
gagtctttgtccaggacgatgagacactcaaagaga

SEQ ID NO: 472 - DNA, 125 bp, Homo sapiens
acttactgtcctgattgggatgacaaggattgggattatggaaaatggaggagcagcagcagtcataaaagaaggaagagatcacatagcagtgcccaggagaacaagcgctgcaaatacaatca

SEQ ID NO: 473 - DNA, 77 bp, Homo sapiens
attttgttgttggtgcgcgacgcagtcagctgcgtgattcccgtgattgcgttacaagctttgtctccttcgacttg

SEQ ID NO: 474 - DNA, 279 bp, Homo sapiens
gtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatca

SEQ ID NO: 475 - DNA, 36 bp, Homo sapiens
tggccttctcccctacagtcctccatgataacaagc

SEQ ID NO: 476 - DNA, 36 bp, Homo sapiens
catctccaccgccttggccttcctgtctctgggggc

SEQ ID NO: 477 - DNA, 500 bp, Homo sapiens
ccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaatta

SEQ ID NO: 478 - DNA, 500 bp, Homo sapiens
tcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcct

SEQ ID NO: 479 - DNA, 500 bp, Homo sapiens
tatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtcttttta

SEQ ID NO: 480 - DNA, 36 bp, Homo sapiens
tgggtgtccggaacctcggcctctactccagtgttt

SEQ ID NO: 481 - DNA, 500 bp, Homo sapiens
ccaccatgcccagctaatttttgtatttttagtagagatggggttccaccatgttggccaggctggtctcaaactcctgacctcaggtgatccacctgcctcgacctcccaaagtgctaggattacaggtttgagccaccgtgcctggcctaagttttgttaatagagatgggatttcatcatgttggctaggctggtcttgaactcctggcctcaaatgatccgcccacctcaacctcccaaagtgctgggattgcaggcgtgagccaccatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcaagaccaccctggccaacatggtgaaaccccatatctactaaaaataatttttttaaaaa

SEQ ID NO: 482 - DNA, 36 bp, Homo sapiens
ttcaagtgattctccagcctcagcctcccgaatagc

SEQ ID NO: 483 - DNA, 36 bp, Homo sapiens
tctgcctgtggtcccagctactcgggaggctgaggc

SEQ ID NO: 484 - DNA, 500 bp, Homo sapiens
accaccatgcccagctaatttttgtatttttagtagagatggggttccaccatgttggccaggctggtctcaaactcctgacctcaggtgatccacctgcctcgacctcccaaagtgctaggattacaggtttgagccaccgtgcctggcctaagttttgttaatagagatgggatttcatcatgttggctaggctggtcttgaactcctggcctcaaatgatccgcccacctcaacctcccaaagtgctgggattgcaggcgtgagccaccatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcaagaccaccctggccaacatggtgaaaccccatatctactaaaaataatttttttaaaa

SEQ ID NO: 485 - DNA, 36 bp, Homo sapiens
gctactcgggaggctgaggcacaagaatcacttgaa

SEQ ID NO: 486 - DNA, 36 bp, Homo sapiens
gaacaaaaggatcaacaggtacagtgtttttcactt

SEQ ID NO: 487 - DNA, 36 bp, Homo sapiens
tgtaaaatcatggcacagattttgacagtgaaagtg

SEQ ID NO: 488 - DNA, 36 bp, Homo sapiens
tgatgacagcacagctaggaagccttaaaaatgtca

SEQ ID NO: 489 - DNA, 36 bp, Homo sapiens
atgtgctgtttgagagagtctcagaggagcaactga

SEQ ID NO: 490 - DNA, 500 bp, Homo sapiens
acgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcacctt

SEQ ID NO: 491 - DNA, 53 bp, Homo sapiens
aagacccagcactgcagttaagtgacttgtactttgtggaacccaagtggctt

SEQ ID NO: 492 - DNA, 273 bp, Homo sapiens
atccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctt

SEQ ID NO: 493 - DNA, 36 bp, Homo sapiens
ccagaatgaattttcttgcttgcggtctttagatat

SEQ ID NO: 494 - DNA, 500 bp, Homo sapiens
tgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaa

SEQ ID NO: 495 - DNA, 500 bp, Homo sapiens
actcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaa

SEQ ID NO: 496 - DNA, 500 bp, Homo sapiens
ttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagcct

SEQ ID NO: 497 - DNA, 500 bp, Homo sapiens
atataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctt

SEQ ID NO: 498 - DNA, 500 bp, Homo sapiens
tgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatc

SEQ ID NO: 499 - DNA, 500 bp, Homo sapiens
aaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgt

SEQ ID NO: 500 - DNA, 173 bp, Homo sapiens
aaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtca

SEQ ID NO: 501 - DNA, 36 bp, Homo sapiens
gcttcctgctgaccttcggcttcatcaccatgacgc

SEQ ID NO: 502 - DNA, 285 bp, Homo sapiens
aattcagtggcatgatcttggctcactgcaacctctgcctcccgggttcaagcaattctcctgcctcagcctcccgagtagctggagttacagacgtccgccaccatgcccggctaatttttgtatttttagtagagacggggtttcacaatgttggccaggctggtcttgaactcccgacctcaggtgatccgcctgcctcggcctcccaaagtgctgggattacaggcgtgagccaccgcgcctggctgaggagcgaagttttctaaggttccttcttgtcct

SEQ ID NO: 503 - DNA, 36 bp, Homo sapiens
gggatgaccaccattcaggaagcagccatcagttgc

SEQ ID NO: 504 - DNA, 500 bp, Homo sapiens
ttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggt

SEQ ID NO: 505 - DNA, 500 bp, Homo sapiens
cagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgc

SEQ ID NO: 506 - DNA, 36 bp, Homo sapiens
gtgcctgggcctggcctggtttgtatttcagcagtc

SEQ ID NO: 507 - DNA, 36 bp, Homo sapiens
ctttctgaactcttgcaggcagcagtacctgtccaa

SEQ ID NO: 508 - DNA, 36 bp, Homo sapiens
cagcaccatgagatgaaggagactaatgagcaaaaa

SEQ ID NO: 509 - DNA, 57 bp, Homo sapiens
ctgcccaggctgatctcgaactcctgagctcaagcgatctgcctgcctcggtctccc

SEQ ID NO: 510 - DNA, 36 bp, Homo sapiens
gaggaggaggacgacgaggaggaggaagatgagagc

SEQ ID NO: 511 - DNA, 500 bp, Homo sapiens
gctaacatggtgaaaacccatctctactaaaaatagaaaaaaattagccaggtgtggtgatgggcacctgtagtcccagctacttgggaggctgaggcaggagaatggcaggaacctgggaggtggagcttgcagtgagccgagatcacgccactgcactccaacctgggcgacagagcgagactccatctcaaaaaagaaaaaaagagttaaagtgatcacggtcagaattcacagtgggtttctagttttctggagctatgtaaaaaaaagaaacaaaggccaggtgtggaggcttacacctgtaatcccagcactttgggaggccaaggtgggtggatcacatgaagtcaggagtttgagaccagcctggccaacatggtgaaaccccatctctactaaaaatacaaaaacataaaaaataaaaaaaataaaattagctgggcgtggtggcaggtgcctataatcccagctactcgggaggctgaggcaggagaact

SEQ ID NO: 512 - DNA, 77 bp, Homo sapiens
cagatggaggtctcaacatgttgcccagactggtctcgaactcctgagctcaagcaatccccctgcctcggcctccc

SEQ ID NO: 513 - DNA, 36 bp, Homo sapiens
aggacccacgtccaccaggcatctcgaacccttggc

SEQ ID NO: 514 - DNA, 36 bp, Homo sapiens
gagttagattccaagacgattgaccccaaagttgca

SEQ ID NO: 515 - DNA, 80 bp, Homo sapiens
gctagagtgcagtggcatgatctcggctcactgcaacctccacctcccgggttcaagcgattctcctgcctcagcctctc

SEQ ID NO: 516 - DNA, 36 bp, Homo sapiens
cagccagtgttgcccttggcctcccaaagtgctggg

SEQ ID NO: 517 - DNA, 36 bp, Homo sapiens
aatgaggaggaggacaaggaggcggcacagctgcgg

SEQ ID NO: 518 - DNA, 36 bp, Homo sapiens
tttgaggagcacgtgcagagtgtcgatatcgcagct

SEQ ID NO: 519 - DNA, 36 bp, Homo sapiens
caaagtccagaaactgacgtgcaaatcggtaactcc

SEQ ID NO: 520 - DNA, 36 bp, Homo sapiens
cctgctttcttcccccagcagccctggcccgccggg

SEQ ID NO: 521 - DNA, 36 bp, Homo sapiens
gccaacccggacctccaggcctccctgtacctgggc

SEQ ID NO: 522 - DNA, 36 bp, Homo sapiens
acctacatcaaaactccgacgtaccgtgagcccgtg

SEQ ID NO: 523 - DNA, 36 bp, Homo sapiens
ggggagaagggtgacgagggccccccaggcatcaac

SEQ ID NO: 524 - DNA, 88 bp, Homo sapiens
tgttggccagactggtttcaaactcctaacctcaggcaatccacctgctttggcctcccaaagtactggaattacaggtgtgaaccat

SEQ ID NO: 525 - DNA, 36 bp, Homo sapiens
ggaccgaaaggacccccgggcccccctgggaaggac

SEQ ID NO: 526 - DNA, 500 bp, Homo sapiens
ggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagc

SEQ ID NO: 527 - DNA, 36 bp, Homo sapiens
gctaagcgccctgcccaggcacgtaacaaaacatag

SEQ ID NO: 528 - DNA, 137 bp, Homo sapiens
gaaccctattgtgaactgcgcctttgaggggtccaggttgcgctccttatgagaatctgatgcccgatgatctgtcactgtttcccatcaaccccagatggcacctcctggttgtaggaaaacaagctcagggctcc

SEQ ID NO: 529 - DNA, 36 bp, Homo sapiens; identical to SEQ ID NO: 527

SEQ ID NO: 530 - DNA, 36 bp, Homo sapiens
attctgtcttctctccagcagcctcgcccaccaagg

SEQ ID NO: 531 - DNA, 36 bp, Homo sapiens
tgattctctggcctcagcctcccaagtagctgggac

SEQ ID NO: 532 - DNA, 86 bp, Homo sapiens
atgttagccaggatggtctcgatctcctgacatcgtgatccgcctgcctgggcctcccaaagtgctgggattacaggtgtgagcca

SEQ ID NO: 533 - DNA, 36 bp, Homo sapiens
ctacccctgttccattagcggcaaccagttcttttt

SEQ ID NO: 534 - DNA, 36 bp, Homo sapiens
tatgcagctggattaaaaggtgctcaggaacggata

SEQ ID NO: 535 - DNA, 500 bp, Homo sapiens
attgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtacctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatcta

SEQ ID NO: 536 - DNA, 58 bp, Homo sapiens
ttcacagactggtctgaaactcctggcctcaagcgatcctcctaccttggcctccgaa

SEQ ID NO: 537 - DNA, 36 bp, Homo sapiens
agagccttgggattacaggtgcctcaggaaccctga

SEQ ID NO: 538 - DNA, 195 bp, Homo sapiens
gatcttggctcaccacaacctctacctccagggttcaagcgatgctcctacctcagcctcctcagtagctgggattacaggcatgtgccatcaccccggctaattctgtatttttagtagagatggggtttctccatgttggccaggctggtcttgaactcccaacctcaggtgatcctcctgcctccgcctccc

SEQ ID NO: 539 - DNA, 36 bp, Homo sapiens
gttttcgaaaaggctgggattacaggcatgagccac

SEQ ID NO: 540 - DNA, 36 bp, Homo sapiens
aactttctgttcctgctgcctgcccagatccaccca

SEQ ID NO: 541 - DNA, 31 bp, Homo sapiens
gcttcaagtgatcctcctgccttggccaccc

SEQ ID NO: 542 - DNA, 214 bp, Homo sapiens
gcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatgatctgcctgcctcaac

SEQ ID NO: 543 - DNA, 36 bp, Homo sapiens
gcagcgtggcccgggctggcaatgccaaggctgcgg

SEQ ID NO: 544 - DNA, 36 bp, Homo sapiens
ggggagcccaggtctgagatgatggaggaggatttg

SEQ ID NO: 545 - DNA, 500 bp, Homo sapiens
cgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtc

SEQ ID NO: 546 - DNA, 500 bp, Homo sapiens
ttccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacag

SEQ ID NO: 547 - DNA, 500 bp, Homo sapiens
cagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatg

SEQ ID NO: 548 - DNA, 144 bp, Homo sapiens
cgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcc

SEQ ID NO: 549 - DNA, 500 bp, Homo sapiens
aatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcc

SEQ ID NO: 550 - DNA, 83 bp, Homo sapiens
tacgccaggccctcatgccaaccctagaagcactgtatcgacaggacccagagtcattacctttccggcagcctgtagatccc

SEQ ID NO: 551 - DNA, 500 bp, Homo sapiens
gtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtgg

SEQ ID NO: 552 - DNA, 500 bp, Homo sapiens
gtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttctt

SEQ ID NO: 553 - DNA, 500 bp, Homo sapiens
cttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtg

SEQ ID NO: 554 - DNA, 32 bp, Homo sapiens
cttgaagaaaactggcagacctcgaaaagaaa

SEQ ID NO: 555 - DNA, 500 bp, Homo sapiens
ttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaa

SEQ ID NO: 556 - DNA, 93 bp, Homo sapiens
cgggacccgcctgcctcctcgcgaacttgggacgagttggaaaatcctccctgagagagccgtgcggctcaggggagcggtttaactcggaaa

SEQ ID NO: 557 - DNA, 36 bp, Homo sapiens
gctctctcccgccgccaggtccctactcctactgca

SEQ ID NO: 558 - DNA, 36 bp, Homo sapiens
gcttttcctggccctgcggtgagtctgcccttccgc

SEQ ID NO: 559 - DNA, 36 bp, Homo sapiens
gatgtccattatagtgaagaggtcttgctggagttg

SEQ ID NO: 560 - DNA, 25 bp, Homo sapiens
tcatttgcggtggaccgtttgactt

SEQ ID NO: 561 - DNA, 500 bp, Homo sapiens
gagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaaccta

SEQ ID NO: 562 - DNA, 500 bp, Homo sapiens
gatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtgg

SEQ ID NO: 563 - DNA, 500 bp, Homo sapiens
ttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatag

SEQ ID NO: 564 - DNA, 500 bp, Homo sapiens
aaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggg

SEQ ID NO: 565 - DNA, 500 bp, Homo sapiens
catgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacgga

SEQ ID NO: 566 - DNA, 500 bp, Homo sapiens
gttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaa

SEQ ID NO: 567 - DNA, 91 bp, Homo sapiens
agctgtttgaccgagtgggggatggcaagatcctgtacagccagtgtggggacgtgatgagggccctgggccagaaccccaccaacgccga

SEQ ID NO: 568 - DNA, 432 bp, Homo sapiens
tgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtgaggggtctccctgggcctcatggtctgtctcttctagcctcctgctcatgct

SEQ ID NO: 569 - DNA, 36 bp, Homo sapiens
ggaacctggcatcgctgggactttgtgtttctaagc

SEQ ID NO: 570 - DNA, 36 bp, Homo sapiens
tgttttttatgtgtctaggactttgtgtttctaagc

SEQ ID NO: 571 - DNA, 36 bp, Homo sapiens
cctaaagccatgtcccaggactttgtgtttctaagc

SEQ ID NO: 572 - DNA, 36 bp, Homo sapiens
cgccctccctgcccgctgtgtccgacttcttggagg

SEQ ID NO: 573 - DNA, 36 bp, Homo sapiens
gctggatcctctaggcaggatggtgatgggaatctt

SEQ ID NO: 574 - DNA, 364 bp, Homo sapiens
ggcaacctgctggggtcctcttccacgctgtggaagctttgtttttcactccttgcagtaaattttgttgctgctcactgtttgggtccgcactgcctttaaatcgcggaggtctgcagcttcactcctgaagccagcgacaccacgaacccaccggtaggagtaaacaactccggacaaactctggatgcgccgccttaaagaactgtaacgctcactgcgagggtctgcggcttcatacttgatgtcagtgagaccaaggaaggaacaaacttcggacgcgccgcctttaagaactgtagcactcaccacgagggtccaggcagcttcgtttttgaagtcagtgagaccaagaacccacaaa

SEQ ID NO: 575 - DNA, 44 bp, Homo sapiens
tcattttaagactcgttggaaccccaggggctgagcttttgaag

SEQ ID NO: 576 - DNA, 500 bp, Homo sapiens
ctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacat

SEQ ID NO: 577 - DNA, 500 bp, Homo sapiens
ataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtacca

SEQ ID NO: 578 - DNA, 36 bp, Homo sapiens
gatgcataatggccgagctgttgactggaagaacat

SEQ ID NO: 579 - DNA, 374 bp, Homo sapiens
caatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaac

SEQ ID NO: 580 - DNA, 500 bp, Homo sapiens
caaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagt

SEQ ID NO: 581 - DNA, 191 bp, Homo sapiens
gtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaa

SEQ ID NO: 582 - DNA, 227 bp, Homo sapiens
ctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagttt

SEQ ID NO: 583 - DNA, 36 bp, Homo sapiens
gctctcatccctgcccagctccccctccggggctcc

SEQ ID NO: 584 - DNA, 36 bp, Homo sapiens
tctggcaccagcgatcaggtcctttatgggcagctg

SEQ ID NO: 585 - DNA, 36 bp, Homo sapiens
ttgatcccatggatgttggtgggtgatgcaggggag

SEQ ID NO: 586 - DNA, 36 bp, Homo sapiens
aacatcaccaacggcgaggaagtggcagtgaagcta

SEQ ID NO: 587 - DNA, 36 bp, Homo sapiens
tcttggtattgagcagagtcgccgagatgacatgga

SEQ ID NO: 588 - DNA, 30 bp, Homo sapiens
ctggcactgcccgatatgctagcatcaatg

SEQ ID NO: 589 - DNA, 500 bp, Homo sapiens
ggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtat

SEQ ID NO: 590 - DNA, 313 bp, Homo sapiens
gtctcttcacacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccgccactcccagagcccctggaactctggcccaaggctctctgactgactccttcccagatcttctcggcttagcggctgaagactgacactgcccgatcgcctcggaagccccctagaccatcacagacgccgagcttccgg

SEQ ID NO: 591 - DNA, 36 bp, Homo sapiens
gtcccatccttcactgagccctgcctcctggacctc

SEQ ID NO: 592 - DNA, 36 bp, Homo sapiens
agctccaggcccctgctggtgaggggagacacctcc

SEQ ID NO: 593 - DNA, 36 bp, Homo sapiens
agccagcagctggctcaggcctcccagactgagcag

SEQ ID NO: 594 - DNA, 36 bp, Homo sapiens
gttcgcgcggccgcgcaggtgagcccaggagcagtg

SEQ ID NO: 595 - DNA, 500 bp, Homo sapiens
gagtctcgctgttgtcgcctaggctggagtgcaatgatgcgatctcggctcactgcaacttcagcttcccgggttcaggtgattctcctgcctcagcctccctggcagctgggattacaggtgcacaccacaactcctgtctaatttttgtatttttcgtagagatggggtttcaccatgttgaccaggctggtctcaaactcctgacctcaagtgatccgcccaccttggcctcccaaaatgctgggattacaggtgtgagccactgcacccagccacctttctctttagagctcactctagtcattaagaatctcagtctcaatgtttgatttgtaagaaggcctcttgctccttgccaggtgcttcatcagtccactcttagatacaaaaaaaagatcctgctgtttctttatggtttccactgcccttttctcttaaacatcatactaaagtcaggcacatcttagaaatgcaactcatatttcatggttttctga

SEQ ID NO: 596 - DNA, 106 bp, Homo sapiens
atgttggccaggatggtctccaactcccgacctccagtgatccgcccgccttggcctcccaaagtgctgggattacaggcgtgagccaccgtccgcccggccgcca

SEQ ID NO: 597 - DNA, 36 bp, Homo sapiens
cgattcctctgcctcagcctccctagttgctgggat

SEQ ID NO: 598 - DNA, 295 bp, Homo sapiens
agtctcctgcctcagcatccggagtagctgggactacaggcgcccgccaccacgcccggctaatttttttttgtgtgtgtgtgtatttttagtagagacggggttttaccgtattagccaggatggtctcatctcctgaccttgtgatccgcccgcctcagcctcccaaagtgctgcgattacaggcgtgagccaccgcacctggcctagaactcctgactttaaatgatccatccgttttggcctcccaaactgctgggattacaggcgtgggccaccgcgcccagtcaatctc

SEQ ID NO: 599 - DNA, 36 bp, Homo sapiens
gcgattctcctgcctcagccttctgagtagctggga

SEQ ID NO: 600 - DNA, 500 bp, Homo sapiens
cgctctgtcaccaggctgtacagtgccgtggcctgtctcggctcactgcaacctccacctcctgggttcaagcgattcttatgcctcagcctcccaagtatctgggactacaggcatgcgccaccacgcccagctgatttttgtatttttagtagagacggggtttcaccatgttgaccaggatggtctcaatctcttgacctcgttatccggctgcctcctcctcccaaagtgctgggattacaggcgtgagccaccatgcctggccacatctacttttttaaatgtgtcattatatttgtgatattgtcatgatgttttctacttatattttattcaaaaattttatactttaagttcttacctttaggtctttgatgcatttttatttgtttatggtgtagggtaaatgttcaacttcatccttttgcttgtggatatccattttttcccagcaccaattgttataaagacagtcctttgcccattgaacggtcttt

SEQ ID NO: 601 - DNA, 500 bp, Homo sapiens
tccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatattttttacctccataatttctgtttttccaatattttaaatatttctgttcttatttccagttttctgattttctgtagttctctg

SEQ ID NO: 602 - DNA, 93 bp, Homo sapiens
gatctcgactcactgcaggctccgactccccagttcaagcgattctcctgcctcagcctccggagtagctgggactacagacacccgccacca

SEQ ID NO: 603 - DNA, 36 bp, Homo sapiens
ccggggccggccctgcaggtggagtctcactcttgt

SEQ ID NO: 604 - DNA, 36 bp, Homo sapiens
tttctgtgtgttccttagatatccgccaggcatcgt

SEQ ID NO: 605 - DNA, 36 bp, Homo sapiens
caatggtgccacatacagatatccgccaggcatcgt

SEQ ID NO: 606 - DNA, 36 bp, Homo sapiens
cctctcctctgtccccaggtgctccatttcttcgtg

SEQ ID NO: 607 - DNA, 100 bp, Homo sapiens
caggtaacccagccctctccaaaggaaccagaccgaattaagccatctgctttctatgccagaccccagcagaccattcagccaagaagcaagctcccca

SEQ ID NO: 608 - DNA, 36 bp, Homo sapiens
gccatttctcccctgcagctctgccccatcgtggat

SEQ ID NO: 609 - DNA, 118 bp, Homo sapiens
tccgcctcgcccttccagccgcacgtgccttacagccctttccgagggatggcgccctacggcccgctggcggccagctccctgctcagccagcagtatgccgcctccctgggtctag

SEQ ID NO: 610 - DNA, 36 bp, Homo sapiens
atctgaagccggccgcaggtgaggtttttgtgctgg

SEQ ID NO: 611 - DNA, 36 bp, Homo sapiens
gaagctctgtagtgctcagcgtgtgcttagggatgc

SEQ ID NO: 612 - DNA, 95 bp, Homo sapiens
tgcttcctatggcctccaccacactagcctcctgaagcgacacatctctcatcagacgtctgtgaatgcagaccccgcctcccacgagatctgga

SEQ ID NO: 613 - DNA, 279 bp, Homo sapiens
tacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacatttcgaaccagtgcttcctaatgacaatgggtcataccgctgttctgcaaattttcagtctaatctcattgaaagccactcaa

SEQ ID NO: 614 - DNA, 36 bp, Homo sapiens
ccatacctgccctgcgaggacctcccagtctctcat

SEQ ID NO: 615 - DNA, 487 bp, Homo sapiens
aattgaagtagtcacttctttcagaatgctaagttccctggaatattttcccagcctactgtgtctatgatagactcaaatattggaagttttaccggctgtgtgtggggtggggaaggaattctgttggttctccggtgagtcctgaagagaccttgtttctggagccaggaagaggagcatagaaagaaaaaggaacaggaaattgttcaaaagaagttcatgaaatgagaaaagcagcaggaaacagctcgggaatcggcgaggctgcagccgaaggaagacatcttccttttaagcagtgactcgggaatcgaggccacttccatcctgtaacgacgccatctggagcatgtggcttccaggggagcagtggctgaggccctgcagtggcttctcactgctacagtccagagttgcacacagcacttctgctcatagtccatcagccaggagctagtcatgtggccacctcgctgcaaggatc

SEQ ID NO: 616 - DNA, 36 bp, Homo sapiens
ggctctcccgcgttgctggcaccgctggcgccgcgg

SEQ ID NO: 617 - DNA, 36 bp, Homo sapiens
gttgacatacatgatcagctccatcaaggaacagtc

SEQ ID NO: 618 - DNA, 427 bp, Homo sapiens
cttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacc

SEQ ID NO: 619 - DNA, 500 bp, Homo sapiens
cctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttat

SEQ ID NO: 620 - DNA, 36 bp, Homo sapiens
tcgtccgccgcaagccagcttccaaacagtttcata

SEQ ID NO: 621 - DNA, 36 bp, Homo sapiens
tcctccttcagcaagcgggagcggcagaggaagtac

SEQ ID NO: 622 - DNA, 36 bp, Homo sapiens
aagaagaacactccagaggatttgcgcaagcaggta

SEQ ID NO: 623 - DNA, 26 bp, Homo sapiens
gcaggtagcgccgctgctgaagagtt

SEQ ID NO: 624 - DNA, 175 bp, Homo sapiens
cgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttc

SEQ ID NO: 625 - DNA, 50 bp, Homo sapiens
ccgcggcgccgggacagccccgggactctgccaggtggatgttgtgcgta

SEQ ID NO: 626 - DNA, 87 bp, Homo sapiens
agagaggcggagaccttaagggaacagctctcatcggccaatcactccctccagctggcctcacagatccagaaggcaccagacgtg

SEQ ID NO: 627 - DNA, 500 bp, Homo sapiens
gatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctg

SEQ ID NO: 628 - DNA, 412 bp, Homo sapiens
cagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatct

SEQ ID NO: 629 - DNA, 36 bp, Homo sapiens
ccaacagcgacctgagcgagccctgtactccagagg

SEQ ID NO: 630 - DNA, 223 bp, Homo sapiens
cgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctg

SEQ ID NO: 631 - DNA, 88 bp, Homo sapiens
ttaaagagaaaatccgagaatatgaacagacactgaagaaccaagccgaaaccatagctcttgagaaggaacagaagttacagaatga

SEQ ID NO: 632 - DNA, 69 bp, Homo sapiens
agagaggcggagaccttaagggaacagctctcatcggccaatcactccctccagctggcctcacagatc

SEQ ID NO: 633 - DNA, 500 bp, Homo sapiens
ccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtcc

SEQ ID NO: 634 - DNA, 500 bp, Homo sapiens
aaatgtttgttcaaggcaaaaaattatttctcagtaaccatcatagctaacatttataaggtgccaatctttattcaaagcacttaaactttattaactcatttaacttcacaacaaccctataagagacagagtctcactccatcacccaggctggagtgcagtggcgcaatctcggctcatcactccgtcgcccaggctggaatgcagtggcgcaatctcggctcactacaacctctgcctcccaagttcaagtgattctcatgcttcagcctcctgatcagctgggactacaggagtgcaccaccatgcccagctaatttttgtattttttggtagagacggagtttcaccatgttggccaggctggtctcaaacttctggcttcaagtgataccccccaacctcggcctcccaaagtgctagaattacaggtgtgagtccccaccaccacatctggcctaggactctgtttttttttttagacaaagggtgtgagc

SEQ ID NO: 635 - DNA, 169 bp, Homo sapiens
tcttcacatggacgcgcatgaaatttggtgccgtgactcggatcgggggacctcccttgggagatcaatcccctgtcctcctgctctttgctccgtgagaaacatccacctatggcctcaggtcctcagaccgaccagcccaagaaacatctcaccaatttcaaatccg

SEQ ID NO: 636 - DNA, 36 bp, Homo sapiens
cagctttattgctcacacaaagcctgtttggtggtc

SEQ ID NO: 637 - DNA, 216 bp, Homo sapiens
ccgggattcctcctaagccgtatcccatctgtgtgggaccccagtgaaaatcggactgttcaactcacctggcagccactcccagagcccctggaactctggcccaaggctctctgaccgactccttcccagatcttctcggcttagcggctgaagactgacactgcccaatcgcctcggaagccccctagaccatcacgcacgccgagcttcggg

SEQ ID NO: 638 - DNA, 36 bp, Homo sapiens
tgctccttcctttcacagagcttgtcggttaaagaa

SEQ ID NO: 639 - DNA, 36 bp, Homo sapiens
aaggagggctgaggaggacttgacatttgaggagga

SEQ ID NO: 640 - DNA, 38 bp, Homo sapiens
tgactgtgtggtgaaggactccatcaactttctggatc

SEQ ID NO: 641 - DNA, 36 bp, Homo sapiens
ctcaggggttccagtgcggtaagagaaaatgtttta

SEQ ID NO: 642 - DNA, 75 bp, Homo sapiens
agggcccctgcagcctgcctgaatttcaactgcatgctgattctcttgccagtctgtcgaaatctgctgtccttc

SEQ ID NO: 643 - DNA, 500 bp, Homo sapiens
tttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaaga

SEQ ID NO: 644 - DNA, 54 bp, Homo sapiens
agactccctgtctttgcggtttgggagatgatgagaaaccacagaattgctagt

SEQ ID NO: 645 - DNA, 500 bp, Homo sapiens
cttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacactt

SEQ ID NO: 646 - DNA, 500 bp, Homo sapiens
ggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagcagctgggattatgaaggggtggcctgcccctccacatctgtgggatatctcatcagccttgatgacttacaagccctcaaggggaagcattttctcctggactccttgatgccggagctgctggtgtttcccgcccagacagatctgcatgaacacccactgtaccgggccggacac

SEQ ID NO: 647 - DNA, 36 bp, Homo sapiens
tgactctttctcctccagctcacaggaagtaaaaga

SEQ ID NO: 648 - DNA, 36 bp, Homo sapiens
cttaaggatgggatacaggatgaccatgaaagctgt

SEQ ID NO: 649 - DNA, 94 bp, Homo sapiens
ctaatcaggcagcaaaagaagacactgtggttttgaagattggctctgttgccatggctccccaggctgacaatccccttggcagatctgtcct

SEQ ID NO: 650 - DNA, 500 bp, Homo sapiens
ccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatat

SEQ ID NO: 651 - DNA, 500 bp, Homo sapiens
acaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactct

SEQ ID NO: 652 - DNA, 250 bp, Homo sapiens
acagcccgtgatcttctaccaataaagccagtggaaattgccatagaggcgtggtgggtggtgcaggctggctatatcacagaagatgacatcaagatatgcactttgcctgagaaatgcgctgttgataagatcatcgattcaggccctcaactctctggatcactagattacaatgtagtacatagtttgtataacaaaggatttatttatctggatgtaccaatatctgatgacagttgtatagcag

SEQ ID NO: 653 - DNA, 500 bp, Homo sapiens
ctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctg

SEQ ID NO: 654 - DNA, 111 bp, Homo sapiens
tgttggccaggctggtctcgaactcctgacctgaagtgatgcacctgccttggcttcccaaggtgctggaattacaggcgtgagccaccgcgcccggcctagaggattctt

SEQ ID NO: 655 - DNA, 86 bp, Homo sapiens
gcccaggctggagtgcagtggcgtgatcttagctcactgcaacctttgcctcctgggttcaagtgattctctagccttagcctcct

SEQ ID NO: 656 - DNA, 116 bp, Homo sapiens
acctcacgtgatcctcccgtctccgcctcccaaagtgctggaattactggcgtgagccaccgaggctggcctgagtattctagtttataacttacaaggtcattcatatgtatatg

SEQ ID NO: 657 - DNA, 298 bp, Homo sapiens
tactgatctatttctgtgccaataccacctactgtaactttaaaataggtttttgtttataccaagtaagaataagttaccattatttttccattaatttttttttttttttttgagacaaggtctcactctgtcactctgttgcccaggctggagtgcagtggcatgatctcagctcactgtagcctctgcctccctgcttcaagctattctcccacctcatcctcccgagtagctgggactgcagatgcgtgccaccacgcctgactagtctttgtatttttagtggagaggggtg

SEQ ID NO: 658 - DNA, 272 bp, Homo sapiens
ttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatg

SEQ ID NO: 659 - DNA, 164 bp, Homo sapiens
tccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagc

SEQ ID NO: 660 - DNA, 382 bp, Homo sapiens
catgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaa

SEQ ID NO: 661 - DNA, 215 bp, Homo sapiens
gctggagtgcagtggcgcgatctcagctcactgcaagctccacctcctgggttcacaccattctcctgcctcagcctcctgagtagctgggactacaggcacccgccaccatgcccagctaatttttttgtatttttagtagagacagggtttcaccatgttagccaggatggtctcgatctcctgaccttgtgatctgccagcctcgggctccc

SEQ ID NO: 662 - DNA, 75 bp, Homo sapiens
ggtcaggctggtcttgaactcccaacctcagatgatctgcccgcctcagccttccaaagtactgggattacagac

SEQ ID NO: 663 - DNA, 29 bp, Homo sapiens
acctcatgatccacccgactcagcctacc

SEQ ID NO: 664 - DNA, 36 bp, Homo sapiens
cctctgaataacctccaggtggctgtgaaaaacaat

SEQ ID NO: 665 - DNA, 36 bp, Homo sapiens
cagcagcagtctgcgtggcaaaactccatgatatca

SEQ ID NO: 666 - DNA, 500 bp, Homo sapiens
tagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatct

SEQ ID NO: 667 - DNA, 38 bp, Homo sapiens
agactgctgtgctagcaatcagcgagactccgtgggca

SEQ ID NO: 668 - DNA, 500 bp, Homo sapiens
gatctcggctgactgcaacctctgcctcccgggttcaagcaattctcctgcctcagcctcccaagtagctgggattacaggtacgtgccaccacacccggctaattttgtatttttagtagagaaggggtttcctatgttggccaggctggtctcacaaactcctgatctcaagtgattggcctgcctcagcctcccaaagtgctgggattacaggcatgagccactgcggttggccaagtagagcaatttttttttttttttgagacggagtctcggtctatcacccaggctggaatgcagtggcgtgatctcaactcactgcaagctccacctcctgggttcatgccattctcctgcctcagcctcccagctacttggaggctgaggcaggagaatggcgtgaatcgggaggcggagcttgcagtgagccgagatcgcgccactgctctccagcgtgggtgacagagcgagactccgtatcaaaaaaaaaaaaaaaat

SEQ ID NO: 669 - DNA, 36 bp, Homo sapiens
ggcctcccaaagtgctgggattacaggcatgagtca

SEQ ID NO: 670 - DNA, 36 bp, Homo sapiens
ggatgtctcaataaaacggcgtgcaatggaattgag

SEQ ID NO: 671 - DNA, 36 bp, Homo sapiens
aatgatatattagcacaggttgccactaatactgag

SEQ ID NO: 672 - DNA, 100 bp, Homo sapiens
tcagcgtctaataattctcccggtcttcctgattgcctgaaagagtcgggacggttcggttgattgtgtttcccggttaggactcggtgtaggagatcca

SEQ ID NO: 673 - DNA, 500 bp, Homo sapiens
aggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttggga

SEQ ID NO: 674 - DNA, 36 bp, Homo sapiens
agtaggaagagctgaaaggatgggtctggcaatttc

SEQ ID NO: 675 - DNA, 500 bp, Homo sapiens
ttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctc

SEQ ID NO: 676 - DNA, 25 bp, Homo sapiens
ggcaatttccctggtggcaacagaa

SEQ ID NO: 677 - DNA, 500 bp, Homo sapiens
agatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaag

SEQ ID NO: 678 - DNA, 500 bp, Homo sapiens
aaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctga

SEQ ID NO: 679 - DNA, 36 bp, Homo sapiens
gcgggagtggcctcgttgattgacgtgagtgaattc

SEQ ID NO: 680 - DNA, 133 bp, Homo sapiens
cgtagaggtcggaggagatcacttgctcttgtagcacatacgggatatctaccacatcagcaggatcctcatcatgttcacaggaacactccactgcatgccaatgcactttgccactttcatattgcagcca

SEQ ID NO: 681 - DNA, 500 bp, Homo sapiens
attccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttca

SEQ ID NO: 682 - DNA, 36 bp, Homo sapiens
atggatggcattggttcagaagtaagtgaaggacaa

SEQ ID NO: 683 - DNA, 91 bp, Homo sapiens
tgtagccgatcgtgttttggctcagctcttaacagaaatggatgggattgaacagctaaaggatgtgaccattttggcagctactaaccgt

SEQ ID NO: 684 - DNA, 36 bp, Homo sapiens
atgtaccaccatgcccagccgatttattttgcatat

SEQ ID NO: 685 - DNA, 500 bp, Homo sapiens
ttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcga

SEQ ID NO: 686 - DNA, 51 bp, Homo sapiens
aggatagtctcacactcctgggctcaagctgtcctcctgccttggtctcct

SEQ ID NO: 687 - DNA, 104 bp, Homo sapiens
gcccaggctggagatcagtggtgcaatctcggctcactgcaagctccgcctcccgagttcacaccattctcctgcctcagcctgccaagtagctgggactacag

SEQ ID NO: 688 - DNA, 36 bp, Homo sapiens
tcgaactcctgacctcaggtaatctgcctacctcgc

SEQ ID NO: 689 - DNA, 123 bp, Homo sapiens
aggctggagtgcaatggcatgatctcggctcactgcaacctctgcctcctgtgttcaagtgatttctcctgcctcaccctcctgagtagctgggactacaggtgcccgccatcatgcccagct

SEQ ID NO: 690 - DNA, 221 bp, Homo sapiens
gcccaggctggagtgcagtggcacgatcttggctcactgcaaactccgccttccaggttcatgccattctcctgcttcagcctcccaagtagctaggactacaggtgcccgccaccacacccggctaattttttgtatttttagtagagatggggtttcaccatgttagccaggatggtctcgatctcctgacctcgtgatctgcctgcctcggcctccca

SEQ ID NO: 691 - DNA, 338 bp, Homo sapiens
ggttggagtgcagtggcatgatctcggctcaccgcaaactctgcctcccgggttcaagcaattctcctgcctcggccttccgagtagctgggactacagacagagtcttgctgtgttgcccaggctggagtgcagtggcacgatcttggctcactgcaaactccgccttccaggttcatgccattctcctgcttcagcctcccaagtagctaggactacaggtgcccgccaccacacccggctaattttttgtatttttagtagagatggggtttcaccatgttagccaggatggtctcgatctcctgacctcgtgatctgcctgcctcggcctccca

SEQ ID NO: 692 - DNA, 36 bp, Homo sapiens
tctccggtctctctccaggtggccatcaggcgcagg

SEQ ID NO: 693 - DNA, 36 bp, Homo sapiens
aaccaaacactgcatgttctcactcttttgatttca

SEQ ID NO: 694 - DNA, 500 bp, Homo sapiens
gcccaggctggaatgcagtggcgtgatctcagatcactgcaacctctgcctcccgggttcaagcaattctcctgcctcagcctcctgagtagctgggattacaggtgcgtgccaccacgcacggctaatttttgtatttttagttgagacggggtttcaccatgttggtcaggctgttcttgaactcctgacctcgtgatccgcccgcctcggcctcccagagtgctgggatttacaggcatgagccaccgcgcccggcctgttttttttttgttggtttgtttttgagacggagtctcgctctgtcgcccagcctggagtgcagtggcaccatctccgctcactgcaagctccgcctcccgggttcacgccattttcctaccgcagcctcccgtgtagctgggactacaggcgcccgccgccacgcccgtcaaattttttttttttttttgtattttttagtagtgacgggtttcaccatgttagccaggatggtctca

SEQ ID NO: 695 - DNA, 500 bp, Homo sapiens
gacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaac

SEQ ID NO: 696 - DNA, 500 bp, Homo sapiens
ttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcggg

SEQ ID NO: 697 - DNA, 97 bp, Homo sapiens
tcccaggactgcttctggacaaaggtgaaggaggaccgctttgagaacaatgaacttttcgccaaacttacccttaccttctctgcccagaccaaga

SEQ ID NO: 698 - DNA, 203 bp, Homo sapiens
gttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcc

SEQ ID NO: 699 - DNA, 500 bp, Homo sapiens
gaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacacc

SEQ ID NO: 700 - DNA, 500 bp, Homo sapiens
aaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaa

SEQ ID NO: 701 - DNA, 500 bp, Homo sapiens
ccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcagga

SEQ ID NO: 702 - DNA, 500 bp, Homo sapiens
gagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcct

SEQ ID NO: 703 - DNA, 36 bp, Homo sapiens
tcacgctaatggtggcaggggagtcaggcctaggga

SEQ ID NO: 704 - DNA, 500 bp, Homo sapiens
aatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgt

SEQ ID NO: 705 - DNA, 79 bp, Homo sapiens
gattgtgcttagaggacaagaaatcgtcagttctgttgttcccaagtcaaacagtgtttttgacttccagaaagcttac

SEQ ID NO: 706 - DNA, 57 bp, Homo sapiens
ttgcccaggctggtctcgacctcctcgcctcaaatgatcctcctgcatcagtctccc

SEQ ID NO: 707 - DNA, 36 bp, Homo sapiens
aaccaaagccctgctgcaatggagtttgacgagaag

SEQ ID NO: 708 - DNA, 500 bp, Homo sapiens
tgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaact

SEQ ID NO: 709 - DNA, 63 bp, Homo sapiens
acaattcagctttggataaaatgctgcagaatgtccagatgccctccaaaaaactggacttca

SEQ ID NO: 710 - DNA, 36 bp, Homo sapiens
caactccttgctgtcctgtggagacctccaggtcac

SEQ ID NO: 711 - DNA, 36 bp, Homo sapiens
agagaggaggtggagatcctgaaggagcagatccga

SEQ ID NO: 712 - DNA, 36 bp, Homo sapiens
cgttaagctggacaacagtgcctccggagccagcgt

SEQ ID NO: 713 - DNA, 36 bp, Homo sapiens
actttattgatgtaggagctggtgtcatagatgaag

SEQ ID NO: 714 - DNA, 36 bp, Homo sapiens
tcctcatcctccctgcaggcgagcccatccggccca

SEQ ID NO: 715 - DNA, 36 bp, Homo sapiens
gattgtgcacaaaccggggcccatcaccctgactgt

SEQ ID NO: 716 - DNA, 36 bp, Homo sapiens
gtacatcgtcaagctcaggtggctcatcggggacaa

SEQ ID NO: 717 - DNA, 36 bp, Homo sapiens
agcttctctacagcaatgggataaggacggagcagg

SEQ ID NO: 718 - DNA, 36 bp, Homo sapiens
cctcttatctggaacatggtaggcgaatcattttca

SEQ ID NO: 719 - DNA, 36 bp, Homo sapiens
acagtgactttaagcctcctgagtagctgggactac

SEQ ID NO: 720 - DNA, 105 bp, Homo sapiens
gccgggctggagggcagtggcacgatctcggctcactgcaacctctgcctcccaggttcaatcaattctcctgcttcaacctcccgagtagctggaactacaggc

SEQ ID NO: 721 - DNA, 36 bp, Homo sapiens
accaagtttgaggagcacgtgcagagtgtcgatatc

SEQ ID NO: 722 - DNA, 85 bp, Homo sapiens
gcagctttcaacaagatctgaagcctgagtgtgtgtacgtgcgcgcgtgcgtgaggccctgccacgattaaagactgagaccggc

SEQ ID NO: 723 - DNA, 36 bp, Homo sapiens
taccttgtggagatccagtgtccagagcaggtggtc

SEQ ID NO: 724 - DNA, 36 bp, Homo sapiens
ggagaccccttcgacaacagcagccgccccagccag

SEQ ID NO: 725 - DNA, 25 bp, Homo sapiens
ggattgcaacgaggagaagatgact

SEQ ID NO: 726 - DNA, 59 bp, Homo sapiens
atcttggctcactgcaacctctacctcctgggttcaagtgattctcttgcctcagcctc

SEQ ID NO: 727 - DNA, 36 bp, Homo sapiens
aaaggaagagattgccaaccgtgagaaacagcgttt

SEQ ID NO: 728 - DNA, 36 bp, Homo sapiens
ctaaagggacaaagagaggtccaccgtttatatcag

SEQ ID NO: 729 - DNA, 500 bp, Homo sapiens
aagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattgga

SEQ ID NO: 730 - DNA, 500 bp, Homo sapiens
aaacaaaagtgatatctcacgctgtcaggcagcctgtttttcttcgcagcatgtcagctccttctgacctggaaatgattggtaatgaagatttggaatttactagagcaaatcagaggcgtcgccacgtgaccagccaccgcagcagctcctttacactcctgcagtcgctggccattgaggacagcagggacaagcccacctacagtgtcctgctagggcagctgtttgctttcatcggcaccaaccctgaccaagctgtgtccagcagcagtttccttttggctgcacagacaaggtggcggcggggaaacactcgcaagcaggcactggtgcacatgcgggaattgctgacagctgccgtacgagtcgggggagtgacgcatcttgtgggtccagtgacgatggtccttcagggaggacccagaattgaagaactcacatgtggtgggatggtcgagcaggtccaggaagcctttggcgagaccatgacctctgtt

SEQ ID NO: 731 - DNA, 101 bp, Homo sapiens
gctctccagacagcaataatgtagccagcagtgctgttggaactgctctgccaaaatttgccatccgagggatgctgaaaacctttgggcttcatggagtc

SEQ ID NO: 732 - DNA, 500 bp, Homo sapiens
gtgccaaagcccaagtttgacaagagcaagtacagcaaggccgggaaggagcagcaccccgtgaaggtggtgagcaccaagcggcctatcaccaagccgcccgccaaggacaaggctgtgctcaacagcgtcagcaggactgccttaagtgagaagaagccaactgtgaagccaaaatcaccagaaaagagcaaaccagatgaaaaggacccagaaaagtcacctaccaaaaaacaagaagtccctgaggaaaaatacctgacgctggaaggatttcacaaatttgttattgaccgagccaggcaagatatccgtagcgtctggagggcgatcttgtcctgtggttacgatcttcactttgagaggtgcgcatgcatcgatgtccgacatgcacagaaggcctcaagaaagtggaccctggagatggacgtggcacttgtgcagtacatcaaccagctatgccgccacctcgccatcacacccgcacggctccatcccca

SEQ ID NO: 733 - DNA, 36 bp, Homo sapiens
gacaagaaagcagcaaaggttcaaaagctgtctaag

SEQ ID NO: 734 - DNA, 36 bp, Homo sapiens
ctaaaaggagtattaaaggtgggccaggagatagaa

SEQ ID NO: 735 - DNA, 36 bp, Homo sapiens
ttgatgacccaagttgccctcagcctcccgagtagc

SEQ ID NO: 736 - DNA, 92 bp, Homo sapiens
ctcatgggaaatccacagtcgtcaaagctatttctggagttcatactgtcaggttcaaaaatgaactagaaagaaatattacaatcaagctt

SEQ ID NO: 737 - DNA, 133 bp, Homo sapiens
tcagatcaccaaaaagtggacagggaggaggagtggaagcaaggaaaaataaggaaagaaatacactggatcccattgtttacaatgtggtcttggctccagtgtgttgaggaccgatctatagcaggaattc

SEQ ID NO: 738 - DNA, 25 bp, Homo sapiens
ttcagcctcccaaagtgctggaatt

SEQ ID NO: 739 - DNA, 25 bp, Homo sapiens
caagtgatcctcccacttcagcctc

SEQ ID NO: 740 - DNA, 285 bp, Homo sapiens
gcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggg

SEQ ID NO: 741 - DNA, 141 bp, Homo sapiens
gcccagcccccgagcagtgcagcctcccgagtgcagagtgcagcccctgcccgccctggcccagctgcccatgtctaccctgctggatcccaagtaatgatgatcccttcccagatctcctacccagcctcccagggggcc

SEQ ID NO: 742 - DNA, 205 bp, Homo sapiens
gcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagc

SEQ ID NO: 743 - DNA, 36 bp, Homo sapiens
gaagcaggagaagctgagagtgagaaaggaggagag

SEQ ID NO: 744 - DNA, 130 bp, Homo sapiens
atggaagaagaagaagaagaggaagaaggagaagcaggagaagcaggagaagctgagagtgagaaaggaggagaggaactgctccccccagagagtacccctattccagccaacttgtctcagaatttgg

SEQ ID NO: 745 - DNA, 240 bp, Homo sapiens
gaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgcccca

SEQ ID NO: 746 - DNA, 500 bp, Homo sapiens
cggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgc

SEQ ID NO: 747 - DNA, 123 bp, Homo sapiens
cggccactggatcccactagactacaaggcataaattgtggcccagacttcactccatcctttgccaaccttggccggacaacccttagcacccgtgggcccccaaggggtgggccaggtggg

SEQ ID NO: 748 - DNA, 500 bp, Homo sapiens
cgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatgga

SEQ ID NO: 749 - DNA, 500 bp, Homo sapiens
cccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagag

SEQ ID NO: 750 - DNA, 36 bp, Homo sapiens
caagactgctggcaacagcgagttcctggggaaaac

SEQ ID NO: 751 - DNA, 500 bp, Homo sapiens
cccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcacca

SEQ ID NO: 752 - DNA, 69 bp, Homo sapiens
aaaactaatccaccacttatccaggaaaagcctgccaagaccagcaaaaagccaccaccgtcaaaggaa

SEQ ID NO: 753 - DNA, 36 bp, Homo sapiens
cgaccggatcctgaggaggcagctgcggtggcagct

SEQ ID NO: 754 - DNA, 26 bp, Homo sapiens
aaagtggagagtgcgattgcagaagg

SEQ ID NO: 755 - DNA, 230 bp, Homo sapiens
gtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacat

SEQ ID NO: 756 - DNA, 123 bp, Homo sapiens
gactggggagaagatacaactgaggaagctcaaaggcgtcgaatggatgaaatcagtgaccatgcaaaagttctgacactcagtgatgatttggaaagaacaattgaggagagggtcaatatc

SEQ ID NO: 757 - DNA, 36 bp, Homo sapiens
tttgggtttgtttcctagctccaaatcttaacttgg

SEQ ID NO: 758 - DNA, 308 bp, Homo sapiens
tgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgccctttcctcctatttccctccaacccccccttccgaaatacatttgctcaatcatttgcacttc

SEQ ID NO: 759 - DNA, 398 bp, Homo sapiens
gtgccaatgatgtatcctgcactctggacggctgcttggaggtcccatgggaacaggagggagcagctccaaatcttaacttggtgtcaagtttcctggctgggagacaagcttttaccgacttcctctgcttgccagcaaagtcatctgctaactggatattggcagcttctctgctgtcttgcagctgcttccggagtgggttccacagggattcccgtgtgttcttggttcagcttgcagagggactttcacactccctggagaccgtttcctcccattctgtctggagttttcggcctaccccaagacaatgagatattcctgccctttcctcctatttccctccaacccccccttccgaaatacatttgctcaatcatttgcacttcataggc

SEQ ID NO: 760 - DNA, 103 bp, Homo sapiens
aggctggagtacagtggtgcaattgtagatggctgcagccctcgacctcctgggctcaagtgatcctcctgccttagcctctcgagtagctgggagtacagat

SEQ ID NO: 761 - DNA, 36 bp, Homo sapiens
ttgtgaagcaggaagacagtgagtatttccatcatc

SEQ ID NO: 762 - DNA, 36 bp, Homo sapiens
attcctctcacagtcactcaccctgttgtccgcaat

SEQ ID NO: 763 - DNA, 36 bp, Homo sapiens
ttttcttttgtctttcagattccactagtatacatt

SEQ ID NO: 764 - DNA, 500 bp, Homo sapiens
cagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacaggga

SEQ ID NO: 765 - DNA, 36 bp, Homo sapiens
tggaacagccacataaagcccttgaagataaggatg

SEQ ID NO: 766 - DNA, 500 bp, Homo sapiens
cacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttg

SEQ ID NO: 767 - DNA, 500 bp, Homo sapiens
aggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctca

SEQ ID NO: 768 - DNA, 36 bp, Homo sapiens
caggctatgatgcaccagggcgtccccctggatacc

SEQ ID NO: 769 - DNA, 500 bp, Homo sapiens
ccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacc

SEQ ID NO: 770 - DNA, 81 bp, Homo sapiens
ccaagccccttgctctccagtatccacttctggagtactctcagtcctgttgctcccctaagtccagccagactgcaaggt

SEQ ID NO: 771 - DNA, 500 bp, Homo sapiens
tcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggac

SEQ ID NO: 772 - DNA, 500 bp, Homo sapiens
attaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtc

SEQ ID NO: 773 - DNA, 500 bp, Homo sapiens
tgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataacca

SEQ ID NO: 774 - DNA, 500 bp, Homo sapiens
tgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggag

SEQ ID NO: 775 - DNA, 36 bp, Homo sapiens
gacgctttccatcaccaggtgcatgatgacgatctt

SEQ ID NO: 776 - DNA, 500 bp, Homo sapiens
gggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtcttt

SEQ ID NO: 777 - DNA, 36 bp, Homo sapiens
gggattctcctacctcagcctcctgagtagctggga

SEQ ID NO: 778 - DNA, 500 bp, Homo sapiens
cgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgac

SEQ ID NO: 779 - DNA, 36 bp, Homo sapiens
gtgcagttaactcagcaggtagtgtggtactatggt

SEQ ID NO: 780 - DNA, 500 bp, Homo sapiens
ccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacgcaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaa

SEQ ID NO: 781 - DNA, 500 bp, Homo sapiens
ccttctgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggacttacttctctggatccagaaacacacagaagtagaaacagtagaccttgtcttgaagctgaaaaataagctgttgcaggctgatcgagagcacttacctgtgaaacctgacactatggaaaagttacggacacacatagatgccattatcttagcatt

SEQ ID NO: 782 - DNA, 210 bp, Homo sapiens
gggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatc

SEQ ID NO: 783 - DNA, 36 bp, Homo sapiens
tgcctgcagggcttccagctgacccactcactgggc

SEQ ID NO: 784 - DNA, 81 bp, Homo sapiens
ttctgtcctggatgtggtacggaaggaggcagagagctgtgactgcctgcagggcttccagctgacccactcactgggcgg

SEQ ID NO: 785 - DNA, 500 bp, Homo sapiens
gtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccag

SEQ ID NO: 786 - DNA, 49 bp, Homo sapiens
gaggcagagagctgtgactgcctgcagggcttccagctgacccactcac

SEQ ID NO: 787 - DNA, 36 bp, Homo sapiens
ggaatgggcactctccttatcagcaagatccgagaa

SEQ ID NO: 788 - DNA, 36 bp, Homo sapiens
ccttatcagcaagatccgcctgcctccgtttccctg

SEQ ID NO: 789 - DNA, 303 bp, Homo sapiens
gccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatgga

SEQ ID NO: 790 - DNA, 154 bp, Homo sapiens
caaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagc

SEQ ID NO: 791 - DNA, 36 bp, Homo sapiens
caagctccagtgtctcaagcacaaatgtctagttct

SEQ ID NO: 792 - DNA, 36 bp, Homo sapiens
tactgttgtggcagaaagttggagttctctccacag

SEQ ID NO: 793 - DNA, 36 bp, Homo sapiens
gatcatctggcctgctggattcgtctgtgatggctg

SEQ ID NO: 794 - DNA, 36 bp, Homo sapiens
accaggcatgaaagcaaggtttgtggacagtggaga

SEQ ID NO: 795 - DNA, 36 bp, Homo sapiens
ccctccacccaaccagaggagagtatacatatctta

SEQ ID NO: 796 - DNA, 202 bp, Homo sapiens
agatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctcc

SEQ ID NO: 797 - DNA, 479 bp, Homo sapiens
ataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactg

SEQ ID NO: 798 - DNA, 500 bp, Homo sapiens
actaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactg

SEQ ID NO: 799 - DNA, 500 bp, Homo sapiens
tacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgaga

SEQ ID NO: 800 - DNA, 78 bp, Homo sapiens
ctcgacaaatcatttcacactggaagaattgtacaagacatgattgtcctgtgtgtctccccctcaaaaatgctggtg

SEQ ID NO: 801 - DNA, 500 bp, Homo sapiens
cttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagt

SEQ ID NO: 802 - DNA, 500 bp, Homo sapiens
ccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgcttta

SEQ ID NO: 803 - DNA, 500 bp, Homo sapiens
accatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtg

SEQ ID NO: 804 - DNA, 500 bp, Homo sapiens
catccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgc

SEQ ID NO: 805 - DNA, 500 bp, Homo sapiens
ctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaa

SEQ ID NO: 806 - DNA, 500 bp, Homo sapiens
ctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttc

SEQ ID NO: 807 - DNA, 139 bp, Homo sapiens
ctagctgagaaaatctataagatccagaaagaactagaagaaaaacgaaggaccagactacagaagcagaacatgctaccaaatgctgcaggcatggttccagtttccatgaatccagggcctaacatgggacagccgc

SEQ ID NO: 808 - DNA, 500 bp, Homo sapiens
caagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaaca

SEQ ID NO: 809 - DNA, 74 bp, Homo sapiens
agatgagcatggcccagccccctattgtaccccggcaaacccctcctcttcagcaccatggacagttggctcaa

SEQ ID NO: 810 - DNA, 500 bp, Homo sapiens
cgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcac

SEQ ID NO: 811 - DNA, 102 bp, Homo sapiens
cgtatgcaacagccttccaaccagggccagttccttcctcagactcagttcccatcacagggaatgaatgtaacaaatatccctttggctccgtccagcggt

SEQ ID NO: 812 - DNA, 500 bp, Homo sapiens
aatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggt

SEQ ID NO: 813 - DNA, 500 bp, Homo sapiens
agcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatca

SEQ ID NO: 814 - DNA, 144 bp, Homo sapiens
agcattgaaggacaggtatcaaatcctccatctactagtagcacagaagtgaattctcaggccattgctgagaagcagccttcccaggaagtgaagatggaggccaaaatggaagtggatcaaccagaaccagcagatactcag

SEQ ID NO: 815 - DNA, 500 bp, Homo sapiens
ccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccag

SEQ ID NO: 816 - DNA, 500 bp, Homo sapiens
acactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaa

SEQ ID NO: 817 - DNA, 53 bp, Homo sapiens
acactgtgttgctacggcaaacagttgtgcacaatacctcgtgatgccactta

SEQ ID NO: 818 - DNA, 500 bp, Homo sapiens
attttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatctt

SEQ ID NO: 819 - DNA, 500 bp, Homo sapiens
tttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtg

SEQ ID NO: 820 - DNA, 500 bp, Homo sapiens
ttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcag

SEQ ID NO: 821 - DNA, 500 bp, Homo sapiens
tgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaa

SEQ ID NO: 822 - DNA, 500 bp, Homo sapiens
gatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaag

SEQ ID NO: 823 - DNA, 111 bp, Homo sapiens
gatggcagaatcctttccataccgaaccaaagccctctttgcctttgaagaaattgatggtgttgacctgtgcttctttggcatgcatgttcaagagtatggctctgactg

SEQ ID NO: 824 - DNA, 500 bp, Homo sapiens
ttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaa

SEQ ID NO: 825 - DNA, 500 bp, Homo sapiens
atctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttaga

SEQ ID NO: 826 - DNA, 36 bp, Homo sapiens
ctgtatggtcagctcagcccggcctccgactccttc

SEQ ID NO: 827 - DNA, 500 bp, Homo sapiens
aacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagag

SEQ ID NO: 828 - DNA, 500 bp, Homo sapiens
gatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgt

SEQ ID NO: 829 - DNA, 25 bp, Homo sapiens
tctgcccttctcccatccaagagaa

SEQ ID NO: 830 - DNA, 439 bp, Homo sapiens
gaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcatta

SEQ ID NO: 831 - DNA, 500 bp, Homo sapiens
aaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtggg

SEQ ID NO: 832 - DNA, 36 bp, Homo sapiens
ggacacccttccatacctccttgcaccagggaacgt

SEQ ID NO: 833 - DNA, 36 bp, Homo sapiens
cccatttccaccaccctgagacctcccgcccagatt

SEQ ID NO: 834 - DNA, 36 bp, Homo sapiens
agagaggaactcagtaaggttacttccaacttggga

SEQ ID NO: 835 - DNA, 179 bp, Homo sapiens
gtgctgggctacaaggacctggctgccatccccaaggacaaggccatcctggacatcgagcggcccgacctcatgatctacgagcctcacttcacttattccctcctggaacacgtggagctgcctcgccagcgcgagcgctcgctgtcacccaaatccacatcccccccaccatcccc

SEQ ID NO: 836 - DNA, 414 bp, Homo sapiens
gcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgccagcgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctg

SEQ ID NO: 837 - DNA, 500 bp, Homo sapiens
ctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctcccccgctatggcaggaccaccctgagccggctacagtccacagagttcagcccatcagggagtgagactggaagcccaggcctgcagaacggagagggc

SEQ ID NO: 838 - DNA, 89 bp, Homo sapiens
ggaaggcgtctcggaggggagcagaggaagaggaggaggaggaagatgacgactctggagaggagatgaaggctctcagggagcgtcag

SEQ ID NO: 839 - DNA, 500 bp, Homo sapiens
agcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacgaggctgggggcctcctgctc

SEQ ID NO: 840 - DNA, 500 bp, Homo sapiens
agggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacgaggctgggggcctcctgctctcgtccctggccctccctgtacagggcaaagccagtctgggctctggcacacag

SEQ ID NO: 841 - DNA, 500 bp, Homo sapiens
agtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctcccccgctatggcaggaccaccctgagccggctacagtccacagagttcagcccatcagggagtgagactggaagcccaggcctgcagaacggagagggccagagggggaggatggaccgggggaactccctgccc

SEQ ID NO: 842 - DNA, 36 bp, Homo sapiens
ggcccgggagaatggcggggcctcacaccctctcct

SEQ ID NO: 843 - DNA, 500 bp, Homo sapiens
aagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccct

SEQ ID NO: 844 - DNA, 47 bp, Homo sapiens
atgccagaaatgacagagaatgagacgcctacaaaaaagcagcacag

SEQ ID NO: 845 - DNA, 36 bp, Homo sapiens
cctgatagtgacctggagttcactcactgctcaccg

SEQ ID NO: 846 - DNA, 370 bp, Homo sapiens
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaatac

SEQ ID NO: 847 - DNA, 228 bp, Homo sapiens
gtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaag

SEQ ID NO: 848 - DNA, 36 bp, Homo sapiens
ttggtgaccgtggtggtcgtggaggccgagggggct

SEQ ID NO: 849 - DNA, 36 bp, Homo sapiens
ttggtgaccgtggtggtcgtggaggcttccattctg

SEQ ID NO: 850 - DNA, 97 bp, Homo sapiens
gtcgagttctcccaccgctctggccgtgacctcattaacttggccaagaagaggaccaacatcattcctgtgatcgaggatgctcgacacccacaca

SEQ ID NO: 851 - DNA, 500 bp, Homo sapiens
aggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacaca

SEQ ID NO: 852 - DNA, 36 bp, Homo sapiens
tcaagaggaccatccagggtgagcccccagcccact

SEQ ID NO: 853 - DNA, 166 bp, Homo sapiens
atgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccattt

SEQ ID NO: 854 - DNA, 330 bp, Homo sapiens
cccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtagg

SEQ ID NO: 855 - DNA, 36 bp, Homo sapiens
ctgggcacagtgctgccccctgcagagcaataacac

SEQ ID NO: 856 - DNA, 36 bp, Homo sapiens
atggacagcctcccactggttatactactccaactg

SEQ ID NO: 857 - DNA, 36 bp, Homo sapiens
agccactgcacctacaagaccgcaggatggaaacaa

SEQ ID NO: 858 - DNA, 36 bp, Homo sapiens
aggacgcggtggaatgggcagcgctggagagcgagg

SEQ ID NO: 859 - DNA, 106 bp, Homo sapiens
gcatatgggcaacaaagctatggaacctatggacagcccactgatgtcagctatacccaggctcagaccactgcaacctatgggcagaccgcctatgcaacttctt

SEQ ID NO: 860 - DNA, 207 bp, Homo sapiens
ccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaac

SEQ ID NO: 861 - DNA, 36 bp, Homo sapiens
ctatgggcaaccgagcagctatggacagcagagtag

SEQ ID NO: 862 - DNA, 75 bp, Homo sapiens
gttatgatcagagcagttactctcagcagaacacctatgggcaaccgagcagctatggacagcagagtagctatg

SEQ ID NO: 863 - DNA, 350 bp, Homo sapiens
cagatcttgatctaggccctcctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccc

SEQ ID NO: 864 - DNA, 42 bp, Homo sapiens
gccgtggtggagacagaggtggcttccgtggtggccggggca

SEQ ID NO: 865 - DNA, 36 bp, Homo sapiens
tggaccgaggtggctttggtggaggaagacgaggtg

SEQ ID NO: 866 - DNA, 36 bp, Homo sapiens
tggatcgtggtggtcccggtggaggaagacgaggtg

SEQ ID NO: 867 - DNA, 116 bp, Homo sapiens
aacaagaaagagaaagcgacatgctattgaaggcaacaaaaagagttccaagaaacagttcccaaatgacatgatcttcagtgcaattgcctcaatgttccctgagaatggtgtcc

SEQ ID NO: 868 - DNA, 85 bp, Homo sapiens
agaaacagttcccaaatgacatgatcttcagtgcaattgcctcaatgttccctgagaatggtgtcccagatgacatgaaggagag

SEQ ID NO: 869 - DNA, 36 bp, Homo sapiens
accgagcaggggccgcaggtgagccaggcagtgccg

SEQ ID NO: 870 - DNA, 45 bp, Homo sapiens
tcagccgccgccacccaggccgtgcctgcccccaaccagcagccc

SEQ ID NO: 871 - DNA, 86 bp, Homo sapiens
gcccaggctggagtgcaattgcacaatcttggctcactgcaagctctgcctcctgggttggagcaattgtcctgcctcagcctcct

SEQ ID NO: 872 - DNA, 36 bp, Homo sapiens
gcttgtttcctgcctcagcccccaccatcctcacgg

SEQ ID NO: 873 - DNA, 36 bp, Homo sapiens
gccgagggcgagggcgaggtgtgtgtgaaagggcca

SEQ ID NO: 874 - DNA, 36 bp, Homo sapiens
agcatgaaggcgatggaggacctgggaagagccaac

SEQ ID NO: 875 - DNA, 36 bp, Homo sapiens
aacagacggaagcccaagcctccagcacctgaagat

SEQ ID NO: 876 - DNA, 271 bp, Homo sapiens
attagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagct

SEQ ID NO: 877 - DNA, 479 bp, Homo sapiens
agacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttcca

SEQ ID NO: 878 - DNA, 60 bp, Homo sapiens
aatacagtcaatccttgcccagatgatactttgatatctttcttgcctctcgcccatatg

SEQ ID NO: 879 - DNA, 51 bp, Homo sapiens
ggagctaaaatcggatttttccaaggagatatcaggctgctcatggatgac

SEQ ID NO: 880 - DNA, 235 bp, Homo sapiens
gacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgac

SEQ ID NO: 881 - DNA, 430 bp, Homo sapiens
atcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatcca

SEQ ID NO: 882 - DNA, 36 bp, Homo sapiens
agcactcaccaccttctggtacgccacgagacccaa

SEQ ID NO: 883 - DNA, 142 bp, Homo sapiens
aattcagcttagagaactatcaacacaggacaatgcaagcccatgagctgttccggtattttcgaatgccagagctggttgacttccgacagtacgtgcgtactcttccgaccaacacgcttatgggcttcggagcttttgc

SEQ ID NO: 884 - DNA, 500 bp, Homo sapiens
ttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtg

SEQ ID NO: 885 - DNA, 498 bp, Homo sapiens
tgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatg

SEQ ID NO: 886 - DNA, 36 bp, Homo sapiens
tttcttaccaatgccaagaagaaaaacgctatggca

SEQ ID NO: 887 - DNA, 212 bp, Homo sapiens
ttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccactt

SEQ ID NO: 888 - DNA, 495 bp, Homo sapiens
ttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaat

SEQ ID NO: 889 - DNA, 500 bp, Homo sapiens
tggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgact

SEQ ID NO: 890 - DNA, 500 bp, Homo sapiens
tgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttaga

SEQ ID NO: 891 - DNA, 36 bp, Homo sapiens
tctgtgttctctctccagcccagccgacctaagtac

SEQ ID NO: 892 - DNA, 36 bp, Homo sapiens
aaggccagtcaaattcaggcgttgttcaagtacagc

SEQ ID NO: 893 - DNA, 36 bp, Homo sapiens
ttattaaggaacctatggaccttgccaccatggaag

SEQ ID NO: 894 - DNA, 500 bp, Homo sapiens
ccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccag

SEQ ID NO: 895 - DNA, 500 bp, Homo sapiens
tcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaac

SEQ ID NO: 896 - DNA, 285 bp, Homo sapiens
ggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaa

SEQ ID NO: 897 - DNA, 500 bp, Homo sapiens
caaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagaga

SEQ ID NO: 898 - DNA, 500 bp, Homo sapiens
aattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatg

SEQ ID NO: 899 - DNA, 500 bp, Homo sapiens
tcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaag

SEQ ID NO: 900 - DNA, 500 bp, Homo sapiens
ggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttca

SEQ ID NO: 901 - DNA, 49 bp, Homo sapiens
cctttccttgaaccagtagaccctaatgatgcaccagattattatggtg

SEQ ID NO: 902 - DNA, 500 bp, Homo sapiens
agagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagg

SEQ ID NO: 903 - DNA, 500 bp, Homo sapiens
aaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaa

SEQ ID NO: 904 - DNA, 151 bp, Homo sapiens
aaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaa

SEQ ID NO: 905 - DNA, 26 bp, Homo sapiens
ccctggcccgtgctggaaaagtgaga

SEQ ID NO: 906 - DNA, 36 bp, Homo sapiens
cccagcttcacccaacagattctgtgtccgaagcct

SEQ ID NO: 907 - DNA, 500 bp, Homo sapiens
ccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaag

SEQ ID NO: 908 - DNA, 500 bp, Homo sapiens
gtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaa

SEQ ID NO: 909 - DNA, 500 bp, Homo sapiens
cacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctc

SEQ ID NO: 910 - DNA, 145 bp, Homo sapiens
tggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctg

SEQ ID NO: 911 - DNA, 500 bp, Homo sapiens
ttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaa

SEQ ID NO: 912 - DNA, 500 bp, Homo sapiens
tccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgtt

SEQ ID NO: 913 - DNA, 36 bp, Homo sapiens
gccctccctggggaccctgccctcctcccaggccag

SEQ ID NO: 914 - DNA, 36 bp, Homo sapiens
taaatgaatctggggaaggaagtgcgctggagaaat

SEQ ID NO: 915 - DNA, 93 bp, Homo sapiens
gatctcggcttactacgacctctgcctcctggattcaagcttttcgcctgcctcagcctcctgagtaactgggactacaggcactcaccacca

SEQ ID NO: 916 - DNA, 105 bp, Homo sapiens
accagtctggagtacagtggcacgatctcggctcacttcagcctccgcctcccgggttcaagcgattctcctgcctcagcctcctgagtagctgggactacaggc

SEQ ID NO: 917 - DNA, 36 bp, Homo sapiens
cgaccagggagtggaatggaacctatcactgcatat

SEQ ID NO: 918 - DNA, 36 bp, Homo sapiens
tcactccaggtgatgcaggtgaatatgtttgcaaac

SEQ ID NO: 919 - DNA, 103 bp, Homo sapiens
agcctgaccctgcagcaccacatgctggaaccagtgcagagaattccacgttacgagctgctgctcaaggagtacatccagaagctgccagcccaggccccag

SEQ ID NO: 920 - DNA, 500 bp, Homo sapiens
gctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgat

SEQ ID NO: 921 - DNA, 36 bp, Homo sapiens
tgccccctcccgccccaggtcgtcctctcagcatgg

SEQ ID NO: 922 - DNA, 36 bp, Homo sapiens
cacgtctcctctgtccaggtgagcacctccgggtct

SEQ ID NO: 923 - DNA, 48 bp, Homo sapiens
tgatctgcccgcctcggcctcccaaagtgcagggattacaggcgtgag

SEQ ID NO: 924 - DNA, 500 bp, Homo sapiens
ggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtcca

SEQ ID NO: 925 - DNA, 500 bp, Homo sapiens
aaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagt

SEQ ID NO: 926 - DNA, 36 bp, Homo sapiens
ccgcaccctgcacacccgtcccctctgtttcctgta

SEQ ID NO: 927 - DNA, 36 bp, Homo sapiens
tgaaccttccccacccaggtttacatccccaccaga

SEQ ID NO: 928 - DNA, 36 bp, Homo sapiens
gacattactatgatccactgcagttccagggaccaa

SEQ ID NO: 929 - DNA, 277 bp, Homo sapiens
ggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaa

SEQ ID NO: 930 - DNA, 500 bp, Homo sapiens
gccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactcc

SEQ ID NO: 931 - DNA, 197 bp, Homo sapiens
caccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacag

SEQ ID NO: 932 - DNA, 500 bp, Homo sapiens
tctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgaga

SEQ ID NO: 933 - DNA, 500 bp, Homo sapiens
caccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccct

SEQ ID NO: 934 - DNA, 500 bp, Homo sapiens
tcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcat

SEQ ID NO: 935 - DNA, 500 bp, Homo sapiens
cccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatc

SEQ ID NO: 936 - DNA, 175 bp, Homo sapiens
atgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctct

SEQ ID NO: 937 - DNA, 36 bp, Homo sapiens
ttccaaaacttatgtcaaatatgaggccccaggatt

SEQ ID NO: 938 - DNA, 36 bp, Homo sapiens
agagaaaagaagggaaagcatgatgaacttgccgat

SEQ ID NO: 939 - DNA, 319 bp, Homo sapiens
aagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaa

SEQ ID NO: 940 - DNA, 500 bp, Homo sapiens
ttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtg

SEQ ID NO: 941 - DNA, 245 bp, Homo sapiens
taattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctct

SEQ ID NO: 942 - DNA, 325 bp, Homo sapiens
tctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttt

SEQ ID NO: 943 - DNA, 36 bp, Homo sapiens
agtcctcaaggccagcaggtgagcggtttttctgtt

SEQ ID NO: 944 - DNA, 478 bp, Homo sapiens
gtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaa

SEQ ID NO: 945 - DNA, 500 bp, Homo sapiens
gattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccg

SEQ ID NO: 946 - DNA, 44 bp, Homo sapiens
gattttggggaagactctgagcatagtgaagaacccaaaaagga

SEQ ID NO: 947 - DNA, 500 bp, Homo sapiens
tgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacaga

SEQ ID NO: 948 - DNA, 500 bp, Homo sapiens
gtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccg

SEQ ID NO: 949 - DNA, 36 bp, Homo sapiens
aaaaaaatttctggctgggattgcaggcgtgagcca

SEQ ID NO: 950 - DNA, 36 bp, Homo sapiens
ccccacctcaggctgcaggatccagcaatcagcctg

SEQ ID NO: 951 - DNA, 36 bp, Homo sapiens
cctgcccaggagccagcgattcaagccccagtaaga

SEQ ID NO: 952 - DNA, 500 bp, Homo sapiens
agtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagag

SEQ ID NO: 953 - DNA, 500 bp, Homo sapiens
tccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgccc

SEQ ID NO: 954 - DNA, 135 bp, Homo sapiens
cacagatgcctattggcagattctcttctccgtcctcaaggtcaccagaaacctgaaggagctggacctaagtggaaactcgctgagccactctgcagtgaagagtctttgtaagaccctgagacgccctcgctg

SEQ ID NO: 955 - DNA, 92 bp, Homo sapiens
gatggaaggaggagcaagtcaatagaagagagagaggaggaatatcaaagggtccgagagagaatatttgcccgagagactggccagaacgg

SEQ ID NO: 956 - DNA, 500 bp, Homo sapiens
agccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccc

SEQ ID NO: 957 - DNA, 249 bp, Homo sapiens
gggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgcc

SEQ ID NO: 958 - DNA, 500 bp, Homo sapiens
ccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccact

SEQ ID NO: 959 - DNA, 500 bp, Homo sapiens
cagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcag

SEQ ID NO: 960 - DNA, 500 bp, Homo sapiens
gaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccacccttt

SEQ ID NO: 961 - DNA, 57 bp, Homo sapiens
gtcactacctggagtaacaaaactcctactgcccttcccagccatccacctgcagcc

SEQ ID NO: 962 - DNA, 222 bp, Homo sapiens
cggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcacc

SEQ ID NO: 963 - DNA, 500 bp, Homo sapiens
ggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtga

SEQ ID NO: 964 - DNA, 163 bp, Homo sapiens
ggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttg

SEQ ID NO: 965 - DNA, 500 bp, Homo sapiens
ttggaacggaacgtggaggtggccctggccggggaggaggggcggcggcgaatgctgggagagtccgacgagcgctgcactaacgcaggatccggctgccgaaggtcctcgccaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttg

SEQ ID NO: 966 - DNA, 201 bp, Homo sapiens
acgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaat

SEQ ID NO: 967 - DNA, 500 bp, Homo sapiens
caagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatg

SEQ ID NO: 968 - DNA, 500 bp, Homo sapiens
acaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactc

SEQ ID NO: 969 - DNA, 500 bp, Homo sapiens
gatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctga

SEQ ID NO: 970 - DNA, 36 bp, Homo sapiens
gatgtgagaaagaagaagcggccacacagtcctctg

SEQ ID NO: 971 - DNA, 433 bp, Homo sapiens
ctattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctga

SEQ ID NO: 972 - DNA, 500 bp, Homo sapiens
agtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtt

SEQ ID NO: 973 - DNA, 36 bp, Homo sapiens
gcactttgggaggccgaggtgggtggatcacgaggt

SEQ ID NO: 974 - DNA, 36 bp, Homo sapiens
acccccacccgttcgcaggtaggacatggggaggga

SEQ ID NO: 975 - DNA, 36 bp, Homo sapiens
gcacccctgggtggcaaggtgcggccgcgggcactg

SEQ ID NO: 976 - DNA, 36 bp, Homo sapiens
gtgcatagttatacaccggtgacaagccatccagaa

SEQ ID NO: 977 - DNA, 349 bp, Homo sapiens
atagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcc

SEQ ID NO: 978 - DNA, 500 bp, Homo sapiens
gatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcc

SEQ ID NO: 979 - DNA, 500 bp, Homo sapiens
gacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttc

SEQ ID NO: 980 - DNA, 381 bp, Homo sapiens
ctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaac

SEQ ID NO: 981 - DNA, 94 bp, Homo sapiens
agtctcgggcggcggtgtccggcgcgcgggcggcctgctgggcgggctgaagggttagcggagcacgggcaaggcggagagtgacggagtcggc

SEQ ID NO: 982 - DNA, 36 bp, Homo sapiens
tggagagtggaaaccatgccaggacatcacaggtga

SEQ ID NO: 983 - DNA, 273 bp, Homo sapiens
gagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcc

SEQ ID NO: 984 - DNA, 36 bp, Homo sapiens
gggtgatggaccatcaaggaaccttcaaagagactg

SEQ ID NO: 985 - DNA, 500 bp, Homo sapiens
ttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgcct

SEQ ID NO: 986 - DNA, 102 bp, Homo sapiens
ttacactgacgtggccctccctctttatgaaaacctcaacattgtggagcagccggtgaacttgagcagccttgcccagaagtatgctgagaaagcaaccca

SEQ ID NO: 987 - DNA, 367 bp, Homo sapiens
ccattgacccatggggggtgcccactggagccaccgcacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtc

SEQ ID NO: 988 - DNA, 57 bp, Homo sapiens
agaagatcttctctgaggtgacgcccaagtgtgaagactgtcagagcctggtgaagc

SEQ ID NO: 989 - DNA, 500 bp, Homo sapiens
aatgaataaaaaagcccgaatatctcacctgacgaacagagtaccaccaacactaaatggtcatttgaatcccaccagtgaaaaatcggctgcaggcctcccactgccccctgcggctgctgccatccccacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattg

SEQ ID NO: 990 - DNA, 500 bp, Homo sapiens
agaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttca

SEQ ID NO: 991 - DNA, 500 bp, Homo sapiens
gaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagcc

SEQ ID NO: 992 - DNA, 36 bp, Homo sapiens
gtcgctgccctgcccccggacgtgaccacgcagtct

SEQ ID NO: 993 - DNA, 36 bp, Homo sapiens
ttttatccacatgatgtgctctctctcccacagatt

SEQ ID NO: 994 - DNA, 36 bp, Homo sapiens
attcttttcctcctgcagctttgggaactactttat

SEQ ID NO: 995 - DNA, 36 bp, Homo sapiens
agccttttgcagtgcctcattcagccatgctgttta

SEQ ID NO: 996 - DNA, 500 bp, Homo sapiens
ccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagag

SEQ ID NO: 997 - DNA, 291 bp, Homo sapiens
caacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggag

SEQ ID NO: 998 - DNA, 262 bp, Homo sapiens
aaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttccc

SEQ ID NO: 999 - DNA, 180 bp, Homo sapiens
tgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgc

SEQ ID NO: 1000 - DNA, 221 bp, Homo sapiens
ctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaatt

SEQ ID NO: 1001 - DNA, 197 bp, Homo sapiens
gggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtc

SEQ ID NO: 1002 - DNA, 500 bp, Homo sapiens
aggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagat

SEQ ID NO: 1003 - DNA, 500 bp, Homo sapiens
tgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagc

SEQ ID NO: 1004 - DNA, 500 bp, Homo sapiens
atccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcg

SEQ ID NO: 1005 - DNA, 182 bp, Homo sapiens
cgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacact

SEQ ID NO: 1006 - DNA, 500 bp, Homo sapiens
caaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcga

SEQ ID NO: 1007 - DNA, 500 bp, Homo sapiens
gcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaac

SEQ ID NO: 1008 - DNA, 500 bp, Homo sapiens
caatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgcc

SEQ ID NO: 1009 - DNA, 500 bp, Homo sapiens
attatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaa

SEQ ID NO: 1010 - DNA, 496 bp, Homo sapiens
aaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagag

SEQ ID NO: 1011 - DNA, 94 bp, Homo sapiens
ttcaggctgctgtctcggccttcttctctactccactgaacccctttctgggaagtgcaatattcatcacttcatatgtccgacctgtgaaatt

SEQ ID NO: 1012 - DNA, 500 bp, Homo sapiens
tgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgc

SEQ ID NO: 1013 - DNA, 239 bp, Homo sapiens
cgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcat

SEQ ID NO: 1014 - DNA, 36 bp, Homo sapiens
caccggctgataaaccaggtcaggacaatcgcagca

SEQ ID NO: 1015 - DNA, 500 bp, Homo sapiens
ttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctc

SEQ ID NO: 1016 - DNA, 500 bp, Homo sapiens
gacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctca

SEQ ID NO: 1017 - DNA, 500 bp, Homo sapiens
accagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccc

SEQ ID NO: 1018 - DNA, 247 bp, Homo sapiens
gtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgtta

SEQ ID NO: 1019 - DNA, 118 bp, Homo sapiens
cctacagcccacaacctggagctgtacgagaattggctgctgtcagggaaacagggagacatctttctgggtgaccgggtatcagattgtcagcgcattgagctcaagcagggctata

SEQ ID NO: 1020 - DNA, 500 bp, Homo sapiens
agctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcct

SEQ ID NO: 1021 - DNA, 180 bp, Homo sapiens
agctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctca

SEQ ID NO: 1022 - DNA, 36 bp, Homo sapiens
gccaagatattagtgaagggcgtcagcttctcataa

SEQ ID NO: 1023 - DNA, 500 bp, Homo sapiens
ctccacgtctgcttcaggaagaaagtgcctgccattcttatcatttctaagcaggttcatgccagcccagaacagagaatcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagag

SEQ ID NO: 1024 - DNA, 500 bp, Homo sapiens
agccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacagtcgtgcagaacagatccctccttgcctgacaagtgagtcttctctcccctctccttggggtacacc

SEQ ID NO: 1025 - DNA, 500 bp, Homo sapiens
aggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgct

SEQ ID NO: 1026 - DNA, 500 bp, Homo sapiens
cgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaac

SEQ ID NO: 1027 - DNA, 160 bp, Homo sapiens
agtgttcctggagaggaggatttcagatctagccagggtgaacgcccgactgcaagctgagtttcgctcttgttgcccaggctggagtgcagtggcgcgatcttggctcaccgcaaactctgcctcccgggttcaagcaattctcctgtctcagcctcct

SEQ ID NO: 1028 - DNA, 500 bp, Homo sapiens
aaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatga

SEQ ID NO: 1029 - DNA, 97 bp, Homo sapiens
ataccagctcctgagagactcgctggatctctatctggcaatgtacccggaccaggtgcagcttctcctcctccaagccaggctttacttccacctg

SEQ ID NO: 1030 - DNA, 500 bp, Homo sapiens
actgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaat

SEQ ID NO: 1031 - DNA, 500 bp, Homo sapiens
tgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacatt

SEQ ID NO: 1032 - DNA, 36 bp, Homo sapiens
tggacttggacactgagggtcgctatctctttttga

SEQ ID NO: 1033 - DNA, 500 bp, Homo sapiens
attaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttat

SEQ ID NO: 1034 - DNA, 36 bp, Homo sapiens
gcactggacattctgcagatgctgggacgtgccgga

SEQ ID NO: 1035 - DNA, 36 bp, Homo sapiens
atcgggggcgagaatgggcctgtcttagaagtgatc

SEQ ID NO: 1036 - DNA, 500 bp, Homo sapiens
cttctgccttatggctttgctattcatcacgcaggcatgaccagggttgaccgaacactcgtggaggatctttttgctgataaacatattcaggttttagtttccacagcaactctagcttggggtgtgaatctccctgcacatacagtcatcatcaaaggcacccaggtgtacagtccagagaaggggcgttggacagaactgggagcactggacattctgcagatgctgggacgtgccggaagaccccagtatgacaccaagggtgaaggcatactcatcacatctcatggggagctacagtactacctgtccctcctcaatcaacaacttcctattgaaagccagatggtttcaaagcttcctgacatgctcaatgcagaaatcgtgctaggaaatgtccagaatgccaaggatgcggtgaactggctgggctatgcctacctctatatccgaatgctgcgatccccaaccctctatggcatctctcatgatgacct

SEQ ID NO: 1037 - DNA, 156 bp, Homo sapiens
tgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtcccc

SEQ ID NO: 1038 - DNA, 97 bp, Homo sapiens
ttttaccacctgctggaggcggctgagggccatgcgcgggagggccaaggcattaagactgaccttccacagtacatcattgggcagctgggcctgg

SEQ ID NO: 1039 - DNA, 500 bp, Homo sapiens
cgagaacccctttgtggtcagcatgttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactct

SEQ ID NO: 1040 - DNA, 500 bp, Homo sapiens
gaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggagg

SEQ ID NO: 1041 - DNA, 500 bp, Homo sapiens
gttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtca

SEQ ID NO: 1042 - DNA, 127 bp, Homo sapiens
gcaattggaggaactgaacctaagtggcaacaagcttaaaaccattcccacaaccatagcaaactgtaaaaggctgcacacccttgttgcacactccaacaacatcagcattttcccagaaatactg

SEQ ID NO: 1043 - DNA, 36 bp, Homo sapiens
accaatgaaattaatcaagcagacaccacccatcct

SEQ ID NO: 1044 - DNA, 500 bp, Homo sapiens
aacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatt

SEQ ID NO: 1045 - DNA, 486 bp, Homo sapiens
ggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattc

SEQ ID NO: 1046 - DNA, 500 bp, Homo sapiens
tactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttc

SEQ ID NO: 1047 - DNA, 363 bp, Homo sapiens
aaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttga

SEQ ID NO: 1048 - DNA, 500 bp, Homo sapiens
ctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattgg

SEQ ID NO: 1049 - DNA, 36 bp, Homo sapiens
agaccagtcgatccccagatcccacatctggtagct

SEQ ID NO: 1050 - DNA, 251 bp, Homo sapiens
aagggcattatcacaactccaagaaccaactaggagtcacccatgacatcatctcctgaatttcatcaccaagcccagctgatcctatttcctaaatggttcctgatttctctcttctgttttctgtctctgccaccactgtcctagcacaggcattgcacatctctcatatgaacgcctgcaggactgtcccttgatgttatccttgcagcccctacattcctactgtgcagccagtaaagtcatattaa

SEQ ID NO: 1051 - DNA, 498 bp, Homo sapiens
ggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaag

SEQ ID NO: 1052 - DNA, 500 bp, Homo sapiens
aggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctc

SEQ ID NO: 1053 - DNA, 36 bp, Homo sapiens
gcagtgctacttgggcaggtttaatgatatccatgt

SEQ ID NO: 1054 - DNA, 500 bp, Homo sapiens
aagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagcta

SEQ ID NO: 1055 - DNA, 500 bp, Homo sapiens
ggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagc

SEQ ID NO: 1056 - DNA, 36 bp, Homo sapiens
gaaggagatggatcaaagagatgccataacaaaaat

SEQ ID NO: 1057 - DNA, 162 bp, Homo sapiens
tccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgt

SEQ ID NO: 1058 - DNA, 36 bp, Homo sapiens
ttaacatccccccatcagcctccccctccccctcct

SEQ ID NO: 1059 - DNA, 36 bp, Homo sapiens
gttcccaacggcccccagtctcccaagcagcaaaag

SEQ ID NO: 1060 - DNA, 66 bp, Homo sapiens
actcagtctttctgttttcacaaagaactcatgaagaggacgatagggaaacccacgtatgccttt

SEQ ID NO: 1061 - DNA, 341 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcag

SEQ ID NO: 1062 - DNA, 398 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaa

SEQ ID NO: 1063 - DNA, 500 bp, Homo sapiens
gatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattca

SEQ ID NO: 1064 - DNA, 36 bp, Homo sapiens
ttgaatttactcacgctggtatgtgaattattcttt

SEQ ID NO: 1065 - DNA, 36 bp, Homo sapiens
tcaacaggctgaagggaggtaggttggagggaagga

SEQ ID NO: 1066 - DNA, 36 bp, Homo sapiens
gactttcaacagaggactgtcttattccactcttca

SEQ ID NO: 1067 - DNA, 36 bp, Homo sapiens
tggtggagagttacgcagtcttatgcaagatctact

SEQ ID NO: 1068 - DNA, 36 bp, Homo sapiens
ttttcatctgtaatgcaggtaagaatgaagggggaa

SEQ ID NO: 1069 - DNA, 36 bp, Homo sapiens
atggaagcatatgctgaggtgagtatatagaaagct

SEQ ID NO: 1070 - DNA, 500 bp, Homo sapiens
atatctgtctgcaggcatgcagcagtctacatgctctgtcctcttccttgccagatgatcttttacagagatgtgtcgatgtttgccgtgttcaactagtgcacagtggaactcgtattcgacaagcatttggaaaactgttgaaatcaattcctttagatgttgtcctaagcaataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttc

SEQ ID NO: 1071 - DNA, 199 bp, Homo sapiens
aggtgcagcgtcaagtgctggagaacagctggttgatctgacttctcgggatggagcctggttcttggaggaactctgcagtatgagcggaaacgtcacctgcttggttcagttactgaagcagtgccacctggtgccacaggacttagatatcccgaaccccatggaagcgtctgagacagttcacttagccaatgga

SEQ ID NO: 1072 - DNA, 115 bp, Homo sapiens
cggtgaattaatccaaccgagaaatggttcagttgatgaaacacccaaaatgtcagctggccagatgcttttggtagcattcgatggcatgtttgctcaagttgaaactgctttc

SEQ ID NO: 1073 - DNA, 36 bp, Homo sapiens
aacttctacccagcatagccccgtcgcagaatttag

SEQ ID NO: 1074 - DNA, 36 bp, Homo sapiens
aaaatgtccagcatgcaggtggtcaaggagctggtc

SEQ ID NO: 1075 - DNA, 500 bp, Homo sapiens
ttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgcca

SEQ ID NO: 1076 - DNA, 223 bp, Homo sapiens
ttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctca

SEQ ID NO: 1077 - DNA, 239 bp, Homo sapiens
gaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggc

SEQ ID NO: 1078 - DNA, 500 bp, Homo sapiens
ctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcag

SEQ ID NO: 1079 - DNA, 500 bp, Homo sapiens
agctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactc

SEQ ID NO: 1080 - DNA, 122 bp, Homo sapiens
aagtgtccccaaggaagtgccaccaggtactaagtcctctccaggttggtcctgggaggctggcccgttggctccttccccatcttcacagaatacacctctggctcaagtgtttgtccctt

SEQ ID NO: 1081 - DNA, 36 bp, Homo sapiens
tttgatattcgagtgctgggcttaggtctgctgata

SEQ ID NO: 1082 - DNA, 36 bp, Homo sapiens
aacttgacctcaataaagcccttcagcatgccggca

SEQ ID NO: 1083 - DNA, 36 bp, Homo sapiens
tttagtggccccaaacggtcacccacaaaagctgta

SEQ ID NO: 1084 - DNA, 36 bp, Homo sapiens
aaacctcagagtgtcacagtgaggctgtcttcaaag

SEQ ID NO: 1085 - DNA, 500 bp, Homo sapiens
aggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttg

SEQ ID NO: 1086 - DNA, 101 bp, Homo sapiens
cacgtgaagcacttcaacgatgttgtagaatttggtgaaaatcaagagttcactgatgacattgagtacttgttaagtggcttaaagagcactcagcctct

SEQ ID NO: 1087 - DNA, 36 bp, Homo sapiens
ttcgccgcacgtcagtcatgcgtaatgggaaaactg

SEQ ID NO: 1088 - DNA, 36 bp, Homo sapiens
gtccatcccaatgaaatggtgagtgtgagtgttggg

SEQ ID NO: 1089 - DNA, 36 bp, Homo sapiens
acggaacagctctgtaaggaccaagttagaaccgga

SEQ ID NO: 1090 - DNA, 36 bp, Homo sapiens
cctgaaaagaccaaaaaggattctggatggagaaca

SEQ ID NO: 1091 - DNA, 136 bp, Homo sapiens
tctggccagcgttacactgttttatggtgattctggatcgccttggatctaaggtctggggtcaacttatggatcctattgtggcatttcaaaccattatcaacaacgcaagctacaatagagagatccgacatat

SEQ ID NO: 1092 - DNA, 138 bp, Homo sapiens
aactggctaaacagctttatccaaaggaaaacgatttggtgtttttagctcctgagagaataaatgaagagaagaaagatacaaagagaaatgacatacaagatctccacgaatatcattctggttatgttcataaat

SEQ ID NO: 1093 - DNA, 36 bp, Homo sapiens
tgcctgtgctggtatcaggcatcatcttctcgctgg

SEQ ID NO: 1094 - DNA, 36 bp, Homo sapiens
gaacctggctgtcaagtggggctcacctggaccgcc

SEQ ID NO: 1095 - DNA, 149 bp, Homo sapiens
cgcctcaaggatggaggcctgtctgcaggctgtggctccggctcctcctctgtcacccccaatagcggtgggacacccttctcccaggacacagcttattccagctgccgcctggacacacccaactcctatggacagggcaccccgct

SEQ ID NO: 1096 - DNA, 500 bp, Homo sapiens
cgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctgg

SEQ ID NO: 1097 - DNA, 36 bp, Homo sapiens
gcaagaactgtctcagtggaatgttttgagtcattg

SEQ ID NO: 1098 - DNA, 36 bp, Homo sapiens
acagcaaatggccctgaggtgctggagtctcaaatt

SEQ ID NO: 1099 - DNA, 36 bp, Homo sapiens
tttgaagctatgagtcaggaattatgcatagtaatg

SEQ ID NO: 1100 - DNA, 137 bp, Homo sapiens
ctcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctcta

SEQ ID NO: 1101 - DNA, 36 bp, Homo sapiens
accatggaagctcaccaggtgattaaagccaatgca

SEQ ID NO: 1102 - DNA, 203 bp, Homo sapiens
acgacccaatctcccagctccttccatctttgatcaagctgcaaaacctccctcttccctagtacacagcccatttgtgttcggacagcccctttccttccagcagcctcagcttcagaaatctccatctcgcaaccttgcttctcgtgagcgcatttacaaaaattatggtgtagctgggcctgcctctgctctctcatctc

SEQ ID NO: 1103 - DNA, 61 bp, Homo sapiens
gatgtgaataaccacagcatgacagccataaggataagccctgaaacactggagcaagatg

SEQ ID NO: 1104 - DNA, 500 bp, Homo sapiens
tggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgcca

SEQ ID NO: 1105 - DNA, 500 bp, Homo sapiens
gtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaaga

SEQ ID NO: 1106 - DNA, 500 bp, Homo sapiens
tcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcgg

SEQ ID NO: 1107 - DNA, 82 bp, Homo sapiens
tcaagcattgccaggccctagcacacaagtcactgcaggcagcaaccatacggcagtacttttaatggatggacaggtcttc

SEQ ID NO: 1108 - DNA, 500 bp, Homo sapiens
ttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagc

SEQ ID NO: 1109 - DNA, 500 bp, Homo sapiens
tagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcaggg

SEQ ID NO: 1110 - DNA, 186 bp, Homo sapiens
ttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacat

SEQ ID NO: 1111 - DNA, 500 bp, Homo sapiens
cattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccacc

SEQ ID NO: 1112 - DNA, 500 bp, Homo sapiens
agaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcacca

SEQ ID NO: 1113 - DNA, 500 bp, Homo sapiens
aaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccatttt

SEQ ID NO: 1114 - DNA, 209 bp, Homo sapiens
aaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctcta

SEQ ID NO: 1115 - DNA, 500 bp, Homo sapiens
tgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttg

SEQ ID NO: 1116 - DNA, 500 bp, Homo sapiens
atgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgt

SEQ ID NO: 1117 - DNA, 500 bp, Homo sapiens
caagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataa

SEQ ID NO: 1118 - DNA, 500 bp, Homo sapiens
gctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcaca

SEQ ID NO: 1119 - DNA, 72 bp, Homo sapiens
gctcgctgcgatgctgaggctggacggggagatgattatgatcccagagagctcatttgtggtgcctgttct

SEQ ID NO: 1120 - DNA, 500 bp, Homo sapiens
acagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgt

SEQ ID NO: 1121 - DNA, 105 bp, Homo sapiens
aaagagcatgcttcttctctggcatcctcaggactgaaaaaggactcacggcttaagacactagagattgctttggagcagaagaaggaggagtgtctgaaaatg

SEQ ID NO: 1122 - DNA, 36 bp, Homo sapiens
ctacgcggacctgatcacccgcgccatcgagagctc

SEQ ID NO: 1123 - DNA, 36 bp, Homo sapiens
ctgagttacctgaaaagggaagtcgaggctcaagag

SEQ ID NO: 1124 - DNA, 36 bp, Homo sapiens
aaagagagacaagccaaggtctacttccccagcagg

SEQ ID NO: 1125 - DNA, 500 bp, Homo sapiens
taaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactg

SEQ ID NO: 1126 - DNA, 325 bp, Homo sapiens
gaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtc

SEQ ID NO: 1127 - DNA, 337 bp, Homo sapiens
tttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagaga

SEQ ID NO: 1128 - DNA, 500 bp, Homo sapiens
aggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcaga

SEQ ID NO: 1129 - DNA, 500 bp, Homo sapiens
agacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagt

SEQ ID NO: 1130 - DNA, 500 bp, Homo sapiens
agatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacg

SEQ ID NO: 1131 - DNA, 500 bp, Homo sapiens
ccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaa

SEQ ID NO: 1132 - DNA, 500 bp, Homo sapiens
gaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagaga

SEQ ID NO: 1133 - DNA, 500 bp, Homo sapiens
aggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaa

SEQ ID NO: 1134 - DNA, 36 bp, Homo sapiens
atggatggccgggaacctgtctacaactcgaacaaa

SEQ ID NO: 1135 - DNA, 36 bp, Homo sapiens
gatgaacggatacggatgattgagaatgccagcgag

SEQ ID NO: 1136 - DNA, 36 bp, Homo sapiens
cagatcggggctgccaaggaagccaaaaagaaatat

SEQ ID NO: 1137 - DNA, 500 bp, Homo sapiens
cttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccag

SEQ ID NO: 1138 - DNA, 308 bp, Homo sapiens
attgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacc

SEQ ID NO: 1139 - DNA, 500 bp, Homo sapiens
agccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacc

SEQ ID NO: 1140 - DNA, 401 bp, Homo sapiens
tctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaag

SEQ ID NO: 1141 - DNA, 500 bp, Homo sapiens
ggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaaga

SEQ ID NO: 1142 - DNA, 264 bp, Homo sapiens
gagatcgagaccatcctggctaacacggtgaaaccccgtctctactaaaaatacaaaaaaattagccaggcgtggtggtgggcgcctgtagtcccaactgctcgggaggctgaggcaggagaatggcatgaacctggaggcggagcttgcagtgagccacgattgtgccactgcactccagcctgggcaacagagcaatactccatctcaaaaaaatatataaataaataaataagatattttgcacatggaaacatctgtggt

SEQ ID NO: 1143 - DNA, 500 bp, Homo sapiens
gagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaa

SEQ ID NO: 1144 - DNA, 500 bp, Homo sapiens
atgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagag

SEQ ID NO: 1145 - DNA, 36 bp, Homo sapiens
cagtttatttccccccaggtttctgcctcaatgctc

SEQ ID NO: 1146 - DNA, 500 bp, Homo sapiens
tggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgc

SEQ ID NO: 1147 - DNA, 36 bp, Homo sapiens
actcacggctcgcctcggcctctacctggagtgatg

SEQ ID NO: 1148 - DNA, 500 bp, Homo sapiens
taccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaa

SEQ ID NO: 1149 - DNA, 10277 bp, Homo sapiens
tgaacccgggaggcgaagcttgcagtaagccgagatcgcgccactgcactccagcctgggtgacagagggagactccatctcaaaaaaaaaagagagaaagtaaaggaataaaagaatggctaccccatagacggagcagccgtgagggctgctggttgcccatttttatggttatttgttgatgatatgctaaacaaggagtggatttttcatgcctcctctttttagaccatatagggtaacttcttgatgttgccgtggcatttgtaaactgtcatggtgctggtaggagtgtagcagggaggatgatgggaggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtaatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaattagccgggcgtggtggcgggcacatgtagtcccagctactagggaggctgaggcaggagaatggtgtgaaccagggaggcggagcttgcagtgagccgagattgtgccactgcactccagcctggacagaagtgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttgtagcaatgatgtatgagttagaaattgcagttccagatgatctctttattaaagagacgatctacacttaatttgatcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcgtcagccccccaagtagctgggaggacaggcgcaagccactgcactccagcctgggtgacagagtgagtctctgtctcaaaaaaaaaaaaaaaaaaaagaaaaaaagtcagttgcagtggctcacgcctgtaatcccagcactttgggaggctgaggcaggcggattacaaggtcaggagatcgagaccaccctggccaacatggtgaaacctcctctctactaaaaatgcaaaaattaggctgggcacggtggctcacacctgtaatcccagcactttgggaggccgaggcgcggagatcacgaggtcaggagattgagaccatcctggctaacacagtgaaaccctgtctctactaaaaatacaaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacagtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggagaacacataacatggcctttagaatgagacgggcattgattggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattctttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaagctctggggagcacccagcgttggacttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccac

SEQ ID NO: 1150 - DNA, 36 bp, Homo sapiens
gataacatcaagacacctgccgagcgtctgcgggga

SEQ ID NO: 1151 - DNA, 36 bp, Homo sapiens
ggccgcttccaccctcagccgatgataatctcaaga

SEQ ID NO: 1152 - DNA, 36 bp, Homo sapiens
ttccgcttccaccatcagcggatgataatctcaaga

SEQ ID NO: 1153 - DNA, 36 bp, Homo sapiens
aggacaggcgcaagccacggcactcagctaattttt

SEQ ID NO: 1154 - DNA, 36 bp, Homo sapiens
tgcgagtacctgaggaaggtgagtgagtgcagacag

SEQ ID NO: 1155 - DNA, 36 bp, Homo sapiens
gaagaccgccagaaaacagaaaatgtttcaacgtgc

SEQ ID NO: 1156 - DNA, 36 bp, Homo sapiens
agtgattgtaatccataggaaaatgtttcaacgtgc

SEQ ID NO: 1157 - DNA, 36 bp, Homo sapiens
gactaccacaaatgcaaaatccccccttctgcaaga

SEQ ID NO: 1158 - DNA, 36 bp, Homo sapiens
gactaccacaaatgcaaagtaaggagcttcctccct

SEQ ID NO: 1159 - DNA, 36 bp, Homo sapiens
aaggctctttgcaactgggtcagaatggcggcagcg

SEQ ID NO: 1160 - DNA, 36 bp, Homo sapiens
gctgtattatcttggcagtcgagttgaactgaaaag

SEQ ID NO: 1161 - DNA, 36 bp, Homo sapiens
atatttatcactacgcagggatttcctgtaaggaat

SEQ ID NO: 1162 - DNA, 36 bp, Homo sapiens
caattacactagttccagccccaggtacccagtttg

SEQ ID NO: 1163 - DNA, 123 bp, Homo sapiens
cagtctcggctccagtgcccatcgctgcccatgcttctgttgctgggcacctctctacatccaccaccgttagtagcagcggggcacagaacagcgacagtacaaagaagactcttgtcacac

SEQ ID NO: 1164 - DNA, 500 bp, Homo sapiens
agcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactg

SEQ ID NO: 1165 - DNA, 190 bp, Homo sapiens
atgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccaga

SEQ ID NO: 1166 - DNA, 95 bp, Homo sapiens
tggaatcaagctggcctgcacttcatgtacctttgttacctctgtgggcgatgctatggccaagcatttggtattcaacccctctcacagatcca

SEQ ID NO: 1167 - DNA, 249 bp, Homo sapiens
agcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagac

SEQ ID NO: 1168 - DNA, 500 bp, Homo sapiens
ttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctct

SEQ ID NO: 1169 - DNA, 500 bp, Homo sapiens
gtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacac

SEQ ID NO: 1170 - DNA, 73 bp, Homo sapiens
gtccggcctgtacaaaatgcaatgaatcaggttgggattgtgctgaacgtacagcaaggccaaacggttagac

SEQ ID NO: 1171 - DNA, 255 bp, Homo sapiens
ttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccaga

SEQ ID NO: 1172 - DNA, 500 bp, Homo sapiens
cccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccaga

SEQ ID NO: 1173 - DNA, 36 bp, Homo sapiens
tacctggcctccctgcagccccgagatggggagcct

SEQ ID NO: 1174 - DNA, 36 bp, Homo sapiens
gggagacctccgctgaggctcgccccgagactcgag

SEQ ID NO: 1175 - DNA, 36 bp, Homo sapiens
tgacctcccctcccctagctcgccccgagactcgag

SEQ ID NO: 1176 - DNA, 500 bp, Homo sapiens
ccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactca

SEQ ID NO: 1177 - DNA, 57 bp, Homo sapiens
acgctgggctcccaggcctcagctcggccctgcgcccatctgcgccacacacagatc

SEQ ID NO: 1178 - DNA, 36 bp, Homo sapiens
tgactatgctgccctcaccgaggccccagcttctcc

SEQ ID NO: 1179 - DNA, 325 bp, Homo sapiens
agcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaa

SEQ ID NO: 1180 - DNA, 36 bp, Homo sapiens
cgtcgtgcgcgccagcaggaatgccaaggtgaaagg

SEQ ID NO: 1181 - DNA, 36 bp, Homo sapiens
ccggcagccgaacgccaggccaccaggagaataaca

SEQ ID NO: 1182 - DNA, 36 bp, Homo sapiens
aacttgctacaccttgagcacaaacggaactatgga

SEQ ID NO: 1183 - DNA, 36 bp, Homo sapiens
caacaacacgaagcaggcgtggccccccaacccccg

SEQ ID NO: 1184 - DNA, 500 bp, Homo sapiens
gatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgc

SEQ ID NO: 1185 - DNA, 92 bp, Homo sapiens
atcttggccaggctggtctcgaactgctgacctcgtgatccacccacctcggtctcccaaagtgctgcgattacaggcgtgagccaccgcac

SEQ ID NO: 1186 - DNA, 156 bp, Homo sapiens
cctggacttcctggtcctcctgctcccaaagctgccttgccccgggagggggccctggctggcgcagtcgttcccgactctgccccagccctggggattcatcctgcccaggagatgccacccaggaggagccctgcagcccccctgtatgcccag

SEQ ID NO: 1187 - DNA, 87 bp, Homo sapiens
tgcccaagctggagtgcaatggcgtgatctcggctcacctcaacctccgcctcccgggttcaagtgattctcctgcctcagcctcct

SEQ ID NO: 1188 - DNA, 36 bp, Homo sapiens
atgagacccagggtcctggtaagcttgattaactct

SEQ ID NO: 1189 - DNA, 36 bp, Homo sapiens
tcaacatcctgtgcgtgggagagacaggtttgggca

SEQ ID NO: 1190 - DNA, 500 bp, Homo sapiens
acccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgcct

SEQ ID NO: 1191 - DNA, 135 bp, Homo sapiens
acccttttcctgcgcaacagagctgggcctccctttctctaatttcccccttaacatgcctggggggcatacaatccaacccgcgccctctcctctcttcctgccaaggtttatagaaacctgagaatctgaggg

SEQ ID NO: 1192 - DNA, 79 bp, Homo sapiens
gtccccctggctggacatgtggggtttgacagcttgcctgaccagctggtgaataagtccgtcagccagggcttctgct

SEQ ID NO: 1193 - DNA, 36 bp, Homo sapiens
tgtctggcctgggagagaaggtggacgttggcaaag

SEQ ID NO: 1194 - DNA, 36 bp, Homo sapiens
ttgagatctttacggcaggagctggcacgggcgagg

SEQ ID NO: 1195 - DNA, 125 bp, Homo sapiens
tcaagtgtgcccctggagtggtaggccccgccgaagctgacatcgacttcgacatcatccgcaatgacaatgacaccttcacggtcaagtacacgccccggggggctggcagctacaccattatg

SEQ ID NO: 1196 - DNA, 240 bp, Homo sapiens
aggctggagtacaatggcgcaatctcggctcactgcaacctccgcttcctggaaccctgttttgtttaacaaaaccttggtctcactgtgtctcctagaatatgtaatttaaattctggctctgaaattacagggaattgtggtagtgatttgagaaccctttcagttctaaaatagtaagattctctggtcaggttgttactaatcttgatttcttttcaatcatgtttcctcccaaaa

SEQ ID NO: 1197 - DNA, 500 bp, Homo sapiens
cgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactt

SEQ ID NO: 1198 - DNA, 500 bp, Homo sapiens
attcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtca

SEQ ID NO: 1199 - DNA, 500 bp, Homo sapiens
tgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgt

SEQ ID NO: 1200 - DNA, 500 bp, Homo sapiens
ttggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtt

SEQ ID NO: 1201 - DNA, 36 bp, Homo sapiens
tgcgcaacgtcagtataggcatgggcagcagtgacg

SEQ ID NO: 1202 - DNA, 36 bp, Homo sapiens
agctcctggggctccgagggaacgtgctggccaccc

SEQ ID NO: 1203 - DNA, 49 bp, Homo sapiens
ttaaatgtgattcttcttactaaacaggcctgactgctgtagctgtgta

SEQ ID NO: 1204 - DNA, 36 bp, Homo sapiens
gaagggccgtggacccagggtggacaatgtcccaga

SEQ ID NO: 1205 - DNA, 164 bp, Homo sapiens
tacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccgga

SEQ ID NO: 1206 - DNA, 36 bp, Homo sapiens
acgggagcgggaggagagcgaggatgaactggaaga

SEQ ID NO: 1207 - DNA, 164 bp, Homo sapiens
gaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgcta

SEQ ID NO: 1208 - DNA, 36 bp, Homo sapiens
tgtatagcaacatcctgtgaaagcagagatccccgg

SEQ ID NO: 1209 - DNA, 36 bp, Homo sapiens
cgtgaaaagctgccgaccatattttccagcagatgc

SEQ ID NO: 1210 - DNA, 500 bp, Homo sapiens
caaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctt

SEQ ID NO: 1211 - DNA, 500 bp, Homo sapiens
aattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcc

SEQ ID NO: 1212 - DNA, 36 bp, Homo sapiens
ttatggagggattctctggccatttttgggctccca

SEQ ID NO: 1213 - DNA, 500 bp, Homo sapiens
cctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgt

SEQ ID NO: 1214 - DNA, 302 bp, Homo sapiens
tattttttttgaggtggagtttcgctcttgttgcccgggctggagtgcaatggtgagatctcaactcactgcaacctctgcccttcaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggtttt

SEQ ID NO: 1215 - DNA, 72 bp, Homo sapiens
aactcactgcaacctctgcccttcaggttcaagtgattctcctccctcagcctcccaagtagctgggattac

SEQ ID NO: 1216 - DNA, 500 bp, Homo sapiens
gccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcagga

SEQ ID NO: 1217 - DNA, 36 bp, Homo sapiens
agagcctgaggatgtaaggtctgaagctgcgttgga

SEQ ID NO: 1218 - DNA, 36 bp, Homo sapiens
gaagaacaagtcatacaggtctggaacaaaaagaat

SEQ ID NO: 1219 - DNA, 36 bp, Homo sapiens
tgtctcagtctgcagcagctcaaatcccagccttct

SEQ ID NO: 1220 - DNA, 36 bp, Homo sapiens
caaccaggtctctctcagccaacttcagttcagcag

SEQ ID NO: 1221 - DNA, 36 bp, Homo sapiens
gacacacatcttctccaggccagagcaaatcttacc

SEQ ID NO: 1222 - DNA, 36 bp, Homo sapiens
aaacacagaaaaccacagctcgacatggattacaga

SEQ ID NO: 1223 - DNA, 36 bp, Homo sapiens
tcctaaagagaataacagtgaggatcaaggttcaaa

SEQ ID NO: 1224 - DNA, 500 bp, Homo sapiens
agcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcc

SEQ ID NO: 1225 - DNA, 152 bp, Homo sapiens
ctagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcag

SEQ ID NO: 1226 - DNA, 36 bp, Homo sapiens
caaggtgtacttccacagactgttccttcacaaccg

SEQ ID NO: 1227 - DNA, 152 bp, Homo sapiens
aggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctcca

SEQ ID NO: 1228 - DNA, 500 bp, Homo sapiens
tccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagt

SEQ ID NO: 1229 - DNA, 500 bp, Homo sapiens
ccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccac

SEQ ID NO: 1230 - DNA, 500 bp, Homo sapiens
agagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaag

SEQ ID NO: 1231 - DNA, 500 bp, Homo sapiens
aagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggag

SEQ ID NO: 1232 - DNA, 151 bp, Homo sapiens
gactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattag

SEQ ID NO: 1233 - DNA, 198 bp, Homo sapiens
atggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgc

SEQ ID NO: 1234 - DNA, 468 bp, Homo sapiens
aggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctcca

SEQ ID NO: 1235 - DNA, 236 bp, Homo sapiens
atggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtataga

SEQ ID NO: 1236 - DNA, 244 bp, Homo sapiens
caggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaa

SEQ ID NO: 1237 - DNA, 105 bp, Homo sapiens
cctcaacctcagctccacttccggcaaccttaactccagttccagcctcaacctcagctccggttccagcctcaactttagctccagttctggcctcaacctcag

SEQ ID NO: 1238 - DNA, 36 bp, Homo sapiens
ctccacttccaccttcaacctcagcttcagttccag

SEQ ID NO: 1239 - DNA, 36 bp, Homo sapiens
ctccagttccagcctcacccttagctccagtttcag

SEQ ID NO: 1240 - DNA, 497 bp, Homo sapiens
gccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcgg

SEQ ID NO: 1241 - DNA, 500 bp, Homo sapiens
cctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatcc

SEQ ID NO: 1242 - DNA, 201 bp, Homo sapiens
ctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaag

SEQ ID NO: 1243 - DNA, 133 bp, Homo sapiens
tgtggcaggaggttttggactcgatgagtttccaccgaaatgtcggagaagtcaggccagagcacaaaagcaaaggatgggaaaaagtatgcaacactcagtttatttaatacttacaaggggaaatcattag

SEQ ID NO: 1244 - DNA, 500 bp, Homo sapiens
gtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaa

SEQ ID NO: 1245 - DNA, 500 bp, Homo sapiens
agtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggag

SEQ ID NO: 1246 - DNA, 90 bp, Homo sapiens
agtttcagcaagaatttcccagcctgcaggcagctggggatcaggaaaaaaaagaaaaggaaacaaatgatgacaactatggacctggac

SEQ ID NO: 1247 - DNA, 500 bp, Homo sapiens
atggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaa

SEQ ID NO: 1248 - DNA, 500 bp, Homo sapiens
aggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccaga

SEQ ID NO: 1249 - DNA, 500 bp, Homo sapiens
ttgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtataga

SEQ ID NO: 1250 - DNA, 500 bp, Homo sapiens
attatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggc

SEQ ID NO: 1251 - DNA, 500 bp, Homo sapiens
agctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaag

SEQ ID NO: 1252 - DNA, 26 bp, Homo sapiens
ttcacatctgccaccacctccaaagt

SEQ ID NO: 1253 - DNA, 500 bp, Homo sapiens
cagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataa

SEQ ID NO: 1254 - DNA, 500 bp, Homo sapiens
gaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggata

SEQ ID NO: 1255 - DNA, 500 bp, Homo sapiens
ccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagtta

SEQ ID NO: 1256 - DNA, 500 bp, Homo sapiens
tatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggc

SEQ ID NO: 1257 - DNA, 500 bp, Homo sapiens
tctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacaga

SEQ ID NO: 1258 - DNA, 500 bp, Homo sapiens
atcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctata

SEQ ID NO: 1259 - DNA, 500 bp, Homo sapiens
gcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagc

SEQ ID NO: 1260 - DNA, 500 bp, Homo sapiens
ctccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccag

SEQ ID NO: 1261 - DNA, 500 bp, Homo sapiens
cacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtact

SEQ ID NO: 1262 - DNA, 50 bp, Homo sapiens
cacagccaccttcagtcagtgcatggaataagcccttaacatcgtttgga

SEQ ID NO: 1263 - DNA, 500 bp, Homo sapiens
gaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggagga

SEQ ID NO: 1264 - DNA, 153 bp, Homo sapiens
gaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcagga

SEQ ID NO: 1265 - DNA, 216 bp, Homo sapiens
gtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaa

SEQ ID NO: 1266 - DNA, 500 bp, Homo sapiens
ccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcagga

SEQ ID NO: 1267 - DNA, 500 bp, Homo sapiens
ttagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaa

SEQ ID NO: 1268 - DNA, 500 bp, Homo sapiens
atatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttat

SEQ ID NO: 1269 - DNA, 500 bp, Homo sapiens
ccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtca

SEQ ID NO: 1270 - DNA, 500 bp, Homo sapiens
gtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgca

SEQ ID NO: 1271 - DNA, 36 bp, Homo sapiens
aaatttgtcagtgaagaaattgaacgagaggcaatt

SEQ ID NO: 1272 - DNA, 500 bp, Homo sapiens
aataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaaga

SEQ ID NO: 1273 - DNA, 146 bp, Homo sapiens
actctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggc

SEQ ID NO: 1274 - DNA, 84 bp, Homo sapiens
aaacctgaggaagtggttgactaatcaagaagagaaatggaaaggaatggaagaaccaggggagaaaactgagctgttctgcca

SEQ ID NO: 1275 - DNA, 500 bp, Homo sapiens
atttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggc

SEQ ID NO: 1276 - DNA, 500 bp, Homo sapiens
gcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagct

SEQ ID NO: 1277 - DNA, 36 bp, Homo sapiens
ctggacacagcccccactatttcgctgcctcatcac

SEQ ID NO: 1278 - DNA, 146 bp, Homo sapiens
aaagctagccaagcagccttctcctttactccacaccagccgaagtttctcctgcttgaacagatccctgtcatcgggtgagagcctcccaggttcccccactcatagcttgtctccccggtctccaacaccaagctaccgctcca

SEQ ID NO: 1279 - DNA, 36 bp, Homo sapiens
ttgccctcttccccacaggaccgtgaatagtctccc

SEQ ID NO: 1280 - DNA, 500 bp, Homo sapiens
ctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcc

SEQ ID NO: 1281 - DNA, 36 bp, Homo sapiens
gaacagcattgacgacaaactgttggtagagaaaat

SEQ ID NO: 1282 - DNA, 36 bp, Homo sapiens
caagcagatatttgtgtgagagaaatagcccggaaa

SEQ ID NO: 1283 - DNA, 36 bp, Homo sapiens
aaccggaaatcgatcaagggaacagagttcagaggc

SEQ ID NO: 1284 - DNA, 36 bp, Homo sapiens
ctcattcctgcacataaggtctgtaaagtatgaaga

SEQ ID NO: 1285 - DNA, 186 bp, Homo sapiens
ggtacaaatgcacatgctagatttgatgagttctatcatcatggaaggtgatggagttactcaagaattattgggctccattcttattaacctcattcctgcacataagaacttaaataaacagtcctttgaccttgcaaaagtgctattgaaaagaacagtccagactattgaggcatgcattgc

SEQ ID NO: 1286 - DNA, 62 bp, Homo sapiens
gatcttgactcactgcaacctctgccccctgggttcaagtgattctcctgcctcagcctgcc

SEQ ID NO: 1287 - DNA, 500 bp, Homo sapiens
gaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacct

SEQ ID NO: 1288 - DNA, 36 bp, Homo sapiens
gagtggcggggccgccaggtgagaccgcgtcgggcg

SEQ ID NO: 1289 - DNA, 36 bp, Homo sapiens
caaagactctttagaaagattggcagtagaagtagt

SEQ ID NO: 1290 - DNA, 500 bp, Homo sapiens
tggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtgtgttcttatgtttctccttatgcatttatgtgttcacttaaaaatgtttttaaatctaaggttttctttgtttatgttcaggtaaggaactgtt

SEQ ID NO: 1291 - DNA, 138 bp, Homo sapiens
gtgtctagcccagagggtactggtacctggctgcattataccagtggtgtgggtactgggcgtcgaagacgcagatcaggggaacaaatcacttcttcccctgtctcccccaaatcattggctttcacatccagtatt

SEQ ID NO: 1292 - DNA, 84 bp, Homo sapiens
tgtttagcacctcggtgctcgggggttcttcaagcgcacctaacctacaggattatgctcgtactcatcgtaaaaagctgacct

SEQ ID NO: 1293 - DNA, 86 bp, Homo sapiens
gatttgttacgggccaatggacagtcctatgtctgtgatgtcaatggcttcagttttgtgaaaaattccatgaagtattatgatga

SEQ ID NO: 1294 - DNA, 500 bp, Homo sapiens
tgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaaga

SEQ ID NO: 1295 - DNA, 36 bp, Homo sapiens
ccaaccctgcctctcctggtgagtatgtaacatttg

SEQ ID NO: 1296 - DNA, 36 bp, Homo sapiens
ctgcatctaggaatgaaggtggaaattcagaaagtt

SEQ ID NO: 1297 - DNA, 36 bp, Homo sapiens
gaaagaagctagaatacactatatgtgagacagagc

SEQ ID NO: 1298 - DNA, 500 bp, Homo sapiens
gatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggaacctgattctgaacagcagcccttaaaacaactcacctgtgatttggaggatgattctgataaattacaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattc

SEQ ID NO: 1299 - DNA, 36 bp, Homo sapiens
gaggatacgggatacaggacattgcctaagatactg

SEQ ID NO: 1300 - DNA, 36 bp, Homo sapiens
ttgagctggtgtcagctggtggaggtcgaagagtga

SEQ ID NO: 1301 - DNA, 202 bp, Homo sapiens
ttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttac

SEQ ID NO: 1302 - DNA, 500 bp, Homo sapiens
aatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttggaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtata

SEQ ID NO: 1303 - DNA, 36 bp, Homo sapiens
aggttccgccgcctccagcgccccatcctgagccga

SEQ ID NO: 1304 - DNA, 84 bp, Homo sapiens
actctggatcctcttgtcaatacctccagtctgataatgaggaagtgtttcccaaaaaatcgactgccactcccaacaattaaa

SEQ ID NO: 1305 - DNA, 500 bp, Homo sapiens
tagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacggagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagat

SEQ ID NO: 1306 - DNA, 26 bp, Homo sapiens
tgactggtcctgtggctcagctctac

SEQ ID NO: 1307 - DNA, 75 bp, Homo sapiens
ctggccaggctggtctcgaactcctgacctcgtgatccacccacctcggcctcttaaagtgctgggattacaggg

SEQ ID NO: 1308 - DNA, 36 bp, Homo sapiens
gcgcctttgggacctcggcctcccaaagtgctggga

SEQ ID NO: 1309 - DNA, 36 bp, Homo sapiens
gaggttgagctgccgtggccctccagaatacccatc

SEQ ID NO: 1310 - DNA, 36 bp, Homo sapiens
gttttttatcccttggaggtgcccgaaatcaggtgg

SEQ ID NO: 1311 - DNA, 500 bp, Homo sapiens
agaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactattt

SEQ ID NO: 1312 - DNA, 475 bp, Homo sapiens
caaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataa

SEQ ID NO: 1313 - DNA, 63 bp, Homo sapiens
agtgattatgtgacagatgaccacgacagagagttttcagtcgcagacctctcggttcagata

SEQ ID NO: 1314 - DNA, 58 bp, Homo sapiens
tcatgcaccctgatctgtcttgtggaacacacactagtagctgtgggcacattatgca

SEQ ID NO: 1315 - DNA, 134 bp, Homo sapiens
gaaacctggattaacaggacgaggcatgtatgaactgaaaccagaatgtgccaaagagttcaacttgtatttctatcacttttcaagggcagaacagtccaaggcagaagaagcgcaacggaaattgaaaagac

SEQ ID NO: 1316 - DNA, 137 bp, Homo sapiens
tgcctccattctgccctctgtttgcaagcctggttaacattttgcagtcagatgtcatgttgtgcatcatgggaacaattctgcaatgggctgtggaacataatggatatgcctggtcagagtccatgctgcaaagg

SEQ ID NO: 1317 - DNA, 36 bp, Homo sapiens
cacccaggaagctggagtgcagaggttgcagtgagc

SEQ ID NO: 1318 - DNA, 500 bp, Homo sapiens
gcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggct

SEQ ID NO: 1319 - DNA, 500 bp, Homo sapiens
gtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaag

SEQ ID NO: 1320 - DNA, 499 bp, Homo sapiens
gatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacag

SEQ ID NO: 1321 - DNA, 500 bp, Homo sapiens
aatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatgg

SEQ ID NO: 1322 - DNA, 500 bp, Homo sapiens
atggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacact

SEQ ID NO: 1323 - DNA, 500 bp, Homo sapiens
acgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattga

SEQ ID NO: 1324 - DNA, 500 bp, Homo sapiens
atgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttca

SEQ ID NO: 1325 - DNA, 119 bp, Homo sapiens
tgcctccattctgccctctgtttgcaagcctggttaacattttgcagtcagatgtcatgttgtgcatcatgggaacaattctgcaatgggctgtggaacataatggatatgcctggtca

SEQ ID NO: 1326 - DNA, 45 bp, Homo sapiens
aagatgagggagagttcacctaccagtcccgtggcagagacagaa

SEQ ID NO: 1327 - DNA, 500 bp, Homo sapiens
caagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaa

SEQ ID NO: 1328 - DNA, 500 bp, Homo sapiens
tcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcat

SEQ ID NO: 1329 - DNA, 500 bp, Homo sapiens
aaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctcc

SEQ ID NO: 1330 - DNA, 397 bp, Homo sapiens
tgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataa

SEQ ID NO: 1331 - DNA, 124 bp, Homo sapiens
tttatgcaaagagcgattcaagaagattcagaagctctggcaccaacacagtgtcacagaggaaattggacatgcacaggaagccaatcagacactggttggcattgactggcaacatttataa

SEQ ID NO: 1332 - DNA, 56 bp, Homo sapiens
ttggccagggtggtctcgaactcctgacctcgtgatccatccgccttggccctccc

SEQ ID NO: 1333 - DNA, 36 bp, Homo sapiens
cacagatgacctcacaggcacctcagccatctgtta

SEQ ID NO: 1334 - DNA, 500 bp, Homo sapiens
caggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtga

SEQ ID NO: 1335 - DNA, 500 bp, Homo sapiens
gagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgg

SEQ ID NO: 1336 - DNA, 500 bp, Homo sapiens
agtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaa

SEQ ID NO: 1337 - DNA, 500 bp, Homo sapiens
gaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagcca

SEQ ID NO: 1338 - DNA, 500 bp, Homo sapiens
atgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaa

SEQ ID NO: 1339 - DNA, 324 bp, Homo sapiens
tgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattg

SEQ ID NO: 1340 - DNA, 500 bp, Homo sapiens
ccagaagggcacccgccagatgccgggcagagctctcctgtatgtggtgtctgtaggcccctactgtgaggtgtctccagtctgggtacacgggggggtcagggacccacttgaggaggcagtctgtcctgtatcagagctcgaatgctgtgctgggagaattgctgctctctttagagctgtcaggcagggacgtttaagtctgctgaagctgtgcctgcagccgccccttcccccacgtgctctgtctcggggagctgtggtgggctccacccagttcaaacttcccagcagctttgtttacactgtgagggtaaaaccatctactcaagcctcagcaatggcggatgcacctcctcccaccaagctcgagtgtcccaggtcaacctcagatgctgtgatagcagtgagaatttcaagccagtggatcttagcttgctgggctccgtgggggtgggacccgctgaaccagacactggagaaaatttcctgttctgctg

SEQ ID NO: 1341 - DNA, 185 bp, Homo sapiens
caactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaag

SEQ ID NO: 1342 - DNA, 500 bp, Homo sapiens
caggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacaga

SEQ ID NO: 1343 - DNA, 500 bp, Homo sapiens
gagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatg

SEQ ID NO: 1344 - DNA, 36 bp, Homo sapiens
tccctttttttccccaaggcactttaaaaatcagca

SEQ ID NO: 1345 - DNA, 500 bp, Homo sapiens
ggtgataaagaaattgctacaaaaatgcaggagcttgccctaagtgaaggtgccttacctcgacacttgcatactgcgatgtttacaataagctcagatcaaaggatgcttacaaatagacagctaagtagacatttagtgggactctggacagctgataatgcaactgcaacaaacttgttgaaacgcattttgccgccaggcttgctggcatacttggaaagctcagatctcgtacctgagaaggatgctgatcggatgcatgttagagacaatgtgaaaatagcaatggatcagtatggaaaatttaataaagttccagagtggcaaagactagctggaaaagctgctaaagaagttgaaaaatttgccaaagaaaaagtggatcttgtattgatgcactggagggataggatgggcattgctcaaaaagagaatataaatcagaagccagtggttcttcgaaagagaagacaaagaataaaaatagaagcaaattg

SEQ ID NO: 1346 - DNA, 36 bp, Homo sapiens
gcccaacctccccatcaggtccagatgccactgtat

SEQ ID NO: 1347 - DNA, 104 bp, Homo sapiens
ctcagcctcagccatttccacagaactcttcccagtcagctgctattactcagccttcatctcagccaggatcccaacctaagcttggcccacctcagcaggga

SEQ ID NO: 1348 - DNA, 436 bp, Homo sapiens
actaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcaggga

SEQ ID NO: 1349 - DNA, 500 bp, Homo sapiens
tctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgt

SEQ ID NO: 1350 - DNA, 36 bp, Homo sapiens
ttccttatactgctttaggtgttagtggcttcatca

SEQ ID NO: 1351 - DNA, 36 bp, Homo sapiens
gaactcaaggcttggcaggtaggaaaacattccttg

SEQ ID NO: 1352 - DNA, 36 bp, Homo sapiens
gaaagtgatgaagttgaggtgtattccagagcaaat

SEQ ID NO: 1353 - DNA, 500 bp, Homo sapiens
catgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcg

SEQ ID NO: 1354 - DNA, 114 bp, Homo sapiens
cataccacgccgggtctgccttcaggctgggaagaaagaaaagatgctaaggggcgcacatactatgtcaatcataacaatcgaaccacaacttggactcgacctatcatgcag

SEQ ID NO: 1355 - DNA, 216 bp, Homo sapiens
cataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaact

SEQ ID NO: 1356 - DNA, 234 bp, Homo sapiens
gggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtg

SEQ ID NO: 1357 - DNA, 36 bp, Homo sapiens
gtaacgaaaaacagggctaatggactgctgaattat

SEQ ID NO: 1358 - DNA, 36 bp, Homo sapiens
aggcgcagatcggcacagtgctgccaagtctaatag

SEQ ID NO: 1359 - DNA, 36 bp, Homo sapiens
gtggatcttctcgtggaggttatggacatcattatg

SEQ ID NO: 1360 - DNA, 36 bp, Homo sapiens
tgttccaaatattggagggtgttcgatgccggagac

SEQ ID NO: 1361 - DNA, 500 bp, Homo sapiens
aaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgtt

SEQ ID NO: 1362 - DNA, 36 bp, Homo sapiens
ttgctaaacttggcacagatcccacccatgtgatgg

SEQ ID NO: 1363 - DNA, 36 bp, Homo sapiens
tacaaggatggctgaggagtactgccacaaacacta

SEQ ID NO: 1364 - DNA, 500 bp, Homo sapiens
atcaaagagctctttccaacaggaaaacagctggagcccttagttgcacctctggcagatggaaaagtggctgtgggccaggatgatctcaccgtggtactcaatgaggaagggatctgcacacagaaatgtgccctgaactggacggacataccagtggccatggagcaccagcctccctacatcattgcagtgttgcctcgatatgttgagatccgaacatttgaaccgaggcttctggtccaaagcattgaattgcaaaggccccgtttcattacctcaggaggatcaaacattatctatgtggccagcaatcattttgtttggagactcatccctgtccccatggcaacccaaatccaacaacttctccaggacaagcagtttgaattggctctgcagctcgcagaaatgaaagatgattctgacagtgaaaagcagcaacaaattcatcacatcaagaacttgtatgccttcaacctcttctgccagaagcgttt

SEQ ID NO: 1365 - DNA, 85 bp, Homo sapiens
tcattgcagtgttgcctcgatatgttgagatccgaacatttgaaccgaggcttctggtccaaagcattgaattgcaaaggccccg

SEQ ID NO: 1366 - DNA, 500 bp, Homo sapiens
agcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttc

SEQ ID NO: 1367 - DNA, 36 bp, Homo sapiens
gaactctccaagctccaggtgcagccttcagccagt

SEQ ID NO: 1368 - DNA, 36 bp, Homo sapiens
tggattcaagattgcaacgacctcctcaaaggactg

SEQ ID NO: 1369 - DNA, 36 bp, Homo sapiens
aggatggaagaacttaagggacagatgttaaaattc

SEQ ID NO: 1370 - DNA, 36 bp, Homo sapiens
gaagaactatgccaccaggtaagataagttctaaaa

SEQ ID NO: 1371 - DNA, 36 bp, Homo sapiens
ccaaacagacagaaaacgccacgaggcaagtgtagt

SEQ ID NO: 1372 - DNA, 36 bp, Homo sapiens
cagcagtccacatagcaggtccacaaaaggtggctc

SEQ ID NO: 1373 - DNA, 36 bp, Homo sapiens
gcccttactcggcataaggaccacgcagcagaagta

SEQ ID NO: 1374 - DNA, 36 bp, Homo sapiens
gcaagatcggtgcctgaacatgcaggagaaagtgaa

SEQ ID NO: 1375 - DNA, 36 bp, Homo sapiens
cagatttctcggcatgaggtgagaggaatgtaggcg

SEQ ID NO: 1376 - DNA, 33 bp, Homo sapiens
gccctgaggcctatgtaaaactcacagaaaatg

SEQ ID NO: 1377 - DNA, 500 bp, Homo sapiens
gctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaa

SEQ ID NO: 1378 - DNA, 123 bp, Homo sapiens
aagtgcaagatgctgacgatgaaagccaagcacgccaccatgctgctgacggtgaccgaggtcgaggggctggcggaagggacagaggacctggatggggagctcctccccacgccttcggcc

SEQ ID NO: 1379 - DNA, 500 bp, Homo sapiens
aaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaac

SEQ ID NO: 1380 - DNA, 133 bp, Homo sapiens
cacatcagagctacacctaatgaaaatggaatttttagaattaaagtaccgtctgctctcactgctggttcttgcagagtcaaagctgaagtcttggatcattaagtacgggaggagagagtcagtggagcag

SEQ ID NO: 1381 - DNA, 129 bp, Homo sapiens
ggagattggaagaagcatgtggaaaccaacagtcgcttgatgaagaagtttgaggagtctcgagcagagttggagaaggtactgcggattgctcaggagggcctggaggaaaagggggatccagaggag

SEQ ID NO: 1382 - DNA, 497 bp, Homo sapiens
gaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagag

SEQ ID NO: 1383 - DNA, 192 bp, Homo sapiens
gaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagttt

SEQ ID NO: 1384 - DNA, 500 bp, Homo sapiens
agtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggccct

SEQ ID NO: 1385 - DNA, 500 bp, Homo sapiens
taagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcg

SEQ ID NO: 1386 - DNA, 500 bp, Homo sapiens
cagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggt

SEQ ID NO: 1387 - DNA, 500 bp, Homo sapiens
gaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgagga

SEQ ID NO: 1388 - DNA, 500 bp, Homo sapiens
gaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtac

SEQ ID NO: 1389 - DNA, 500 bp, Homo sapiens
gggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgca

SEQ ID NO: 1390 - DNA, 120 bp, Homo sapiens
gggagctggacagatgacttgacccagttgagcctgctgaaggacaccctctctgcctatatcagtgctgatgatatctccattcttaatgaacgcgtagagcttctgcaaaggcagtgg

SEQ ID NO: 1391 - DNA, 500 bp, Homo sapiens
caaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacag

SEQ ID NO: 1392 - DNA, 127 bp, Homo sapiens
gaccctggtagccgtgcagcagcttgataagaacatgagcagcctgaggacctggctcgctcacatcgagtcagagctggccaagccaatagtctacgattcctgtaactcggaagaaatacagaga

SEQ ID NO: 1393 - DNA, 500 bp, Homo sapiens
aaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagaga

SEQ ID NO: 1394 - DNA, 36 bp, Homo sapiens
ggttcggctgaaatcatgagtctggtgctggcagaa

SEQ ID NO: 1395 - DNA, 500 bp, Homo sapiens
ggaaaacctgctgttgcagtgatagataatggaagaggaatgacctctaaacagcttaacaactgggccgtgtataggttgtcaaaattcacaaggcaaggtgactttgaaagtgatcattcaggatatgttcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttg

SEQ ID NO: 1396 - DNA, 500 bp, Homo sapiens
tcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaagg

SEQ ID NO: 1397 - DNA, 500 bp, Homo sapiens
actggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaa

SEQ ID NO: 1398 - DNA, 57 bp, Homo sapiens
ttgcccaggctggtctcgaactcgtgagctcaagcagtctgcccacctctgcctccc

SEQ ID NO: 1399 - DNA, 36 bp, Homo sapiens
agttcctcgatgtggccggtcttttatcagaaatca

SEQ ID NO: 1400 - DNA, 36 bp, Homo sapiens
agccatgagaagggcaagatcaccgttctgcagctc

SEQ ID NO: 1401 - DNA, 36 bp, Homo sapiens
gcggtttgtgggctaaaggactgtcatgtgctcacc

SEQ ID NO: 1402 - DNA, 36 bp, Homo sapiens
gatgacagtggcatggagcttctagtgaacaataaa

SEQ ID NO: 1403 - DNA, 500 bp, Homo sapiens
accaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttg

SEQ ID NO: 1404 - DNA, 500 bp, Homo sapiens
atcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtga

SEQ ID NO: 1405 - DNA, 497 bp, Homo sapiens
atcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatgg

SEQ ID NO: 1406 - DNA, 500 bp, Homo sapiens
atcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagat

SEQ ID NO: 1407 - DNA, 500 bp, Homo sapiens
cctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactg

SEQ ID NO: 1408 - DNA, 500 bp, Homo sapiens
caggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgc

SEQ ID NO: 1409 - DNA, 117 bp, Homo sapiens
tttagtagctcaggctctgtttcggatcacttggttttgcaccctcagttggcaacggggaacttcatcatcaaagccgtgtggttacctggttcacagaccgagttagcaattgtc

SEQ ID NO: 1410 - DNA, 500 bp, Homo sapiens
ggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagc

SEQ ID NO: 1411 - DNA, 500 bp, Homo sapiens
accacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaat

SEQ ID NO: 1412 - DNA, 500 bp, Homo sapiens
ggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcag

SEQ ID NO: 1413 - DNA, 36 bp, Homo sapiens
ctacacgtatgcgctcagttccagctattcttcaga

SEQ ID NO: 1414 - DNA, 36 bp, Homo sapiens
gggacaggaatcaaaaatgcggtgcgtctttctacg

SEQ ID NO: 1415 - DNA, 466 bp, Homo sapiens
aggctggagtgcaatggcacgatctcggctcactgcaacctctgcctcctgggttcatgtgattctcctgcctcagcctcccaagtagctgggattacaggtgtgtgccaccatgctcggctgatttttgtatgtttagtagagacggggtttcgccatgttggccaggctggtctcgaactcctgaactcaggtgatccacctacctcagcctcccaaagtgctaggattacaggcgtgagccactgcgcctggcctatcccattttatagtaggagatattgaacccaagagagttaactaacttgccaaaagtcacacagctattaagtggccattgaattgcagatctgttttacttctgatgacatattgaaaatttatgcccttacagggcaaggggattctgtctattgctgctctatccccagcacctagctagtgtcttttggctttcaaatatttg

SEQ ID NO: 1416 - DNA, 130 bp, Homo sapiens
ttgcccaggctggtctctaactcctggcctcaagtgatcctgctgcctctgtctctgcctcccaaagtgctgggagccaccacgcctggcctcttgtccccattttacagtcaagagtaacttcatctga

SEQ ID NO: 1417 - DNA, 500 bp, Homo sapiens
tctttatgttctctgctgtgttcccagcttctagaacagtgcccagtacctagtagatgttcactcacagttgtttaaatgaataaataaatgaattctctcacaacgtgtttaattttattttacaggctcacagtaatgaaaccatagggagtgtccggtggaaaatagccaagcagttgtgctctcctgtggataatatacagatatttacaaatgatagcctggtaggtttaaataagcagttttgatgaataataaatgatataatataaatatttagcctgatatgaataatttcctcttccttttcctctcaataattaagaaaccactttttgcagctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttct

SEQ ID NO: 1418 - DNA, 500 bp, Homo sapiens
ctgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgtt

SEQ ID NO: 1419 - DNA, 500 bp, Homo sapiens
cctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatg

SEQ ID NO: 1420 - DNA, 193 bp, Homo sapiens
tgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatccct

SEQ ID NO: 1421 - DNA, 170 bp, Homo sapiens
ccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaagga

SEQ ID NO: 1422 - DNA, 92 bp, Homo sapiens
agaagttctgggccttcttgaaatattccaaagccaaaaatttggacattgaccccaaactgcaagaatacctcggcaaattccgacgtctt

SEQ ID NO: 1423 - DNA, 500 bp, Homo sapiens
gcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagc

SEQ ID NO: 1424 - DNA, 444 bp, Homo sapiens
caactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctg

SEQ ID NO: 1425 - DNA, 500 bp, Homo sapiens
gccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaaca

SEQ ID NO: 1426 - DNA, 500 bp, Homo sapiens
ttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagct

SEQ ID NO: 1427 - DNA, 500 bp, Homo sapiens
gaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcat

SEQ ID NO: 1428 - DNA, 36 bp, Homo sapiens
ttgccccctgtttcccagctcgcccagtgactggcc

SEQ ID NO: 1429 - DNA, 36 bp, Homo sapiens
ctcagttttcggtcctagcaagtgggagaacagggg

SEQ ID NO: 1430 - DNA, 26 bp, Homo sapiens
gaaactagaagctaaggtgaagaagc

SEQ ID NO: 1431 - DNA, 500 bp, Homo sapiens
ctcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggt

SEQ ID NO: 1432 - DNA, 36 bp, Homo sapiens
actgcactctccctgcagctcgcactgcctccgagc

SEQ ID NO: 1433 - DNA, 500 bp, Homo sapiens
ttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcggg

SEQ ID NO: 1434 - DNA, 305 bp, Homo sapiens
ctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatc

SEQ ID NO: 1435 - DNA, 500 bp, Homo sapiens
tatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcaga

SEQ ID NO: 1436 - DNA, 500 bp, Homo sapiens
taaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattct

SEQ ID NO: 1437 - DNA, 500 bp, Homo sapiens
tcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagttt

SEQ ID NO: 1438 - DNA, 140 bp, Homo sapiens
tgtgctatacatccaattccagcatcactgtggagaaaagctgtttgtctccccagcatactttatcgccttcactgccttttgactgcagaggagctaagagcccagactgccagcgatgctggcgtgggagtcagatc

SEQ ID NO: 1439 - DNA, 36 bp, Homo sapiens
ctgctcagagacggcgagaactatgttgtgcttctg

SEQ ID NO: 1440 - DNA, 96 bp, Homo sapiens
atcttggccaggctggtcttgaactcctgaccttgtgatccacctgcctcagactcccaaagtgctgggattacaagtgtgagccaccgcgcccag

SEQ ID NO: 1441 - DNA, 36 bp, Homo sapiens
ttcttcaaaattctgctggtgagagtgtgtgaaggt

SEQ ID NO: 1442 - DNA, 280 bp, Homo sapiens
aagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaa

SEQ ID NO: 1443 - DNA, 36 bp, Homo sapiens
gctgagctccaggagcagctcaaagccgtgcacgag

SEQ ID NO: 1444 - DNA, 36 bp, Homo sapiens
cagcaacagcaatgtgagcaagaaggagccagcgcc

SEQ ID NO: 1445 - DNA, 500 bp, Homo sapiens
tttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggc

SEQ ID NO: 1446 - DNA, 500 bp, Homo sapiens
aggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaa

SEQ ID NO: 1447 - DNA, 500 bp, Homo sapiens
ttgccggctcctccaagatgaagggcttctcgtcctcagagtcggagagctccagtgagtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagcagccgcccccgcctccccagcagcccccaccgcctccacctccgcagcagcaacagcagccgccacccccgcctcccccaccctccatgccgcagcaggcagccccggcgatgaagtcctcgcccccacccttcattgccacccaggtgcccgtcctggagccccagctcccaggcagcgtctttgaccccatcggccacttcacccagcccatcctgcacctgccgcagcctgagctgccccctcacctgccccagccgcctgagcacagcactccaccccatctcaaccagcacgca

SEQ ID NO: 1448 - DNA, 36 bp, Homo sapiens
agaagagctggcttttagggtcatgcgtcttcagga

SEQ ID NO: 1449 - DNA, 36 bp, Homo sapiens
ttcttccaacagatccaggagctcaatttggaaatg

SEQ ID NO: 1450 - DNA, 36 bp, Homo sapiens
caaaagcaacaggtccagtttatgctaaaggaattt

SEQ ID NO: 1451 - DNA, 36 bp, Homo sapiens
aggaagcgggcaaaacaattccatgaagcttggaaa

SEQ ID NO: 1452 - DNA, 36 bp, Homo sapiens
gcctgctggatgcagaagatgtggatgtgccatctc

SEQ ID NO: 1453 - DNA, 367 bp, Homo sapiens
agtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgcta

SEQ ID NO: 1454 - DNA, 209 bp, Homo sapiens
gtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgcctt

SEQ ID NO: 1455 - DNA, 75 bp, Homo sapiens
cgctgttatgacaaaccctggttggtaaacagtaaagctggcacccctatcagggacagccattctcctgacctc

SEQ ID NO: 1456 - DNA, 500 bp, Homo sapiens
agaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtg

SEQ ID NO: 1457 - DNA, 500 bp, Homo sapiens
cagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactg

SEQ ID NO: 1458 - DNA, 500 bp, Homo sapiens
ttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactc

SEQ ID NO: 1459 - DNA, 500 bp, Homo sapiens
caagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtct

SEQ ID NO: 1460 - DNA, 500 bp, Homo sapiens
atgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtgga

SEQ ID NO: 1461 - DNA, 500 bp, Homo sapiens
taggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttc

SEQ ID NO: 1462 - DNA, 206 bp, Homo sapiens
gtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcc

SEQ ID NO: 1463 - DNA, 500 bp, Homo sapiens
tagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgca

SEQ ID NO: 1464 - DNA, 135 bp, Homo sapiens
cagctacaggaagctttgttgcattgtgggaagtttcaagatgccttggagccattgctcagctggttggcagataccgaggagctcatagccaatcagaaacctccatctgctgagtataaagtggtgaaagca

SEQ ID NO: 1465 - DNA, 500 bp, Homo sapiens
ggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacagg

SEQ ID NO: 1466 - DNA, 500 bp, Homo sapiens
gatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggc

SEQ ID NO: 1467 - DNA, 500 bp, Homo sapiens
gataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctgg

SEQ ID NO: 1468 - DNA, 500 bp, Homo sapiens
ctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgt

SEQ ID NO: 1469 - DNA, 500 bp, Homo sapiens
aatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagc

SEQ ID NO: 1470 - DNA, 153 bp, Homo sapiens
cagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcc

SEQ ID NO: 1471 - DNA, 94 bp, Homo sapiens
agcaagttgaaacgaccaacaccaacttttcattctagtcggacatcccttgctggtgataccagcaatagttcttccccggcctccacaggtg

SEQ ID NO: 1472 - DNA, 500 bp, Homo sapiens
ggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgccc

SEQ ID NO: 1473 - DNA, 89 bp, Homo sapiens
tactccccctttggaaagtaagcaacgtagaaatctcccaagcaagattcctcttccaactgcaatgacaagtggatccaaatcacgaa

SEQ ID NO: 1474 - DNA, 500 bp, Homo sapiens
cttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaa

SEQ ID NO: 1475 - DNA, 36 bp, Homo sapiens
gtctgcagacaaggcagggaaacgttttgatggtaa

SEQ ID NO: 1476 - DNA, 36 bp, Homo sapiens
aaaaacagtatgcgccgagtgagtagcttccttttt

SEQ ID NO: 1477 - DNA, 36 bp, Homo sapiens
attatatgagagattcagaacgtggtgtagtatggg

SEQ ID NO: 1478 - DNA, 77 bp, Homo sapiens
gatgcttttcaaagagaggccattcagtgtgttgacaataatcagtctgttctagtatctgcacatacctcagcggg

SEQ ID NO: 1479 - DNA, 500 bp, Homo sapiens
tacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgc

SEQ ID NO: 1480 - DNA, 500 bp, Homo sapiens
aattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaagga

SEQ ID NO: 1481 - DNA, 67 bp, Homo sapiens
aattttaatactgcaatgcaagtgcttcgagatgcaggtgatttggccaaaggagaccagaaagggc

SEQ ID NO: 1482 - DNA, 90 bp, Homo sapiens
attcagatgtctggtcgtgctggaaggagaggaatggatgatagaggaattgtaattcttatggtagatgaaaagatgagcccaacaatt

SEQ ID NO: 1483 - DNA, 69 bp, Homo sapiens
tgaggcgcctggaagaattgcttcgacaaatgtgtcaagcagcaaaagccattggaaacactgagctgg

SEQ ID NO: 1484 - DNA, 36 bp, Homo sapiens
gataaagacaagaaggagaaatctgcaactcgacct

SEQ ID NO: 1485 - DNA, 36 bp, Homo sapiens
cccagggcagaggccagcggtcacggagactcacca

SEQ ID NO: 1486 - DNA, 363 bp, Homo sapiens
gagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagac

SEQ ID NO: 1487 - DNA, 500 bp, Homo sapiens
ctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagc

SEQ ID NO: 1488 - DNA, 500 bp, Homo sapiens
agtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaa

SEQ ID NO: 1489 - DNA, 36 bp, Homo sapiens
acttccccagtcttcttcctcagagagcagcccacc

SEQ ID NO: 1490 - DNA, 399 bp, Homo sapiens
gtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaa

SEQ ID NO: 1491 - DNA, 200 bp, Homo sapiens
cactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctg

SEQ ID NO: 1492 - DNA, 500 bp, Homo sapiens
acttagaaccccgccaagagaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatga

SEQ ID NO: 1493 - DNA, 36 bp, Homo sapiens
ccagatccagaacgccaccagtaacccgccgtcgtt

SEQ ID NO: 1494 - DNA, 212 bp, Homo sapiens
ctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaa

SEQ ID NO: 1495 - DNA, 36 bp, Homo sapiens
gctctagatctcgagcctctccagccactcaccggc

SEQ ID NO: 1496 - DNA, 292 bp, Homo sapiens
caccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagc

SEQ ID NO: 1497 - DNA, 129 bp, Homo sapiens
gttggcagaattaaatgagaagaagaatgaaagactccgtgctgcctttggcatcagtgattcttacgtagatggcagctcttttgatcctcagcgtcgtgcccgagaagctaaacaaccagctcctga

SEQ ID NO: 1498 - DNA, 500 bp, Homo sapiens
agcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagaga

SEQ ID NO: 1499 - DNA, 500 bp, Homo sapiens
taaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccacc

SEQ ID NO: 1500 - DNA, 36 bp, Homo sapiens
accccctggcgagcggagcagcagcagtgagcgggg

SEQ ID NO: 1501 - DNA, 36 bp, Homo sapiens
accccaaccaggacaaagacaggagaaggaggcata

SEQ ID NO: 1502 - DNA, 500 bp, Homo sapiens
aaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcg

SEQ ID NO: 1503 - DNA, 500 bp, Homo sapiens
aaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaattcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaag

SEQ ID NO: 1504 - DNA, 75 bp, Homo sapiens
aaaacgaggtgccaatcaacatgccactgatgaagaagggaaagaccctttgagcatagctgtggaagcagccaa

SEQ ID NO: 1505 - DNA, 36 bp, Homo sapiens
ccatcttcttcttgccaggcggctggagaacaatcg

SEQ ID NO: 1506 - DNA, 36 bp, Homo sapiens
tcccaagagccccatgaggttagcaccattgtcatc

SEQ ID NO: 1507 - DNA, 36 bp, Homo sapiens
ctgataagccggtgcaaggagacatcctcaatgata

SEQ ID NO: 1508 - DNA, 64 bp, Homo sapiens
ttcctgagcagcctttggatgttactgccaatggctttccacagggaacaacaaagaaaacaat

SEQ ID NO: 1509 - DNA, 36 bp, Homo sapiens
ccctggctgtgtcctcaggtggcagtttatgtcaga

SEQ ID NO: 1510 - DNA, 83 bp, Homo sapiens
cgggctggagtgcaatggcatgatctcagctgactgcaacctccacctcccaggttcaagctattctcctgtctcagcctcct

SEQ ID NO: 1511 - DNA, 36 bp, Homo sapiens
atccaccgcccccacctgagttctatccaggacccc

SEQ ID NO: 1512 - DNA, 36 bp, Homo sapiens
tcccctccactcctgcagccgaagccaaggccgcag

SEQ ID NO: 1513 - DNA, 36 bp, Homo sapiens
aacgtctacatgcccacgagccagccgccgccacct

SEQ ID NO: 1514 - DNA, 460 bp, Homo sapiens
gtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccacc

SEQ ID NO: 1515 - DNA, 322 bp, Homo sapiens
tgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacag

SEQ ID NO: 1516 - DNA, 213 bp, Homo sapiens
ccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcg

SEQ ID NO: 1517 - DNA, 211 bp, Homo sapiens
ggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaag

SEQ ID NO: 1518 - DNA, 313 bp, Homo sapiens
ccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttgggga

SEQ ID NO: 1519 - DNA, 48 bp, Homo sapiens
gaagtgggcggtgggtggtgggtggtggggaataagcccctgaagagg

SEQ ID NO: 1520 - DNA, 41 bp, Homo sapiens
aagcagccgccagcgcctattacaacccaggcaatcctcac

SEQ ID NO: 1521 - DNA, 36 bp, Homo sapiens
acagtctttgccatcccgtggagcacatgatccaga

SEQ ID NO: 1522 - DNA, 36 bp, Homo sapiens
gcctcccaaagtgctgggattataggcatgagccac

SEQ ID NO: 1523 - DNA, 60 bp, Homo sapiens
atgttggccaggctggtcttgaactcttggcctcaagtggtccacctgcctcagcctccc

SEQ ID NO: 1524 - DNA, 500 bp, Homo sapiens
gtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggat

SEQ ID NO: 1525 - DNA, 500 bp, Homo sapiens
agctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacct

SEQ ID NO: 1526 - DNA, 60 bp, Homo sapiens
aatctcggctcactacacctctgcctcccaggctcaagcacttctcctgcctcagactcc

SEQ ID NO: 1527 - DNA, 26 bp, Homo sapiens
actagatggtgcctcgctcgtgccca

SEQ ID NO: 1528 - DNA, 82 bp, Homo sapiens
aaggagaggacagtgaggaagatgaagataccgagtactttgatgccatggaagactccacatccttcatcaccgtgatcac

SEQ ID NO: 1529 - DNA, 434 bp, Homo sapiens
cggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaaga

SEQ ID NO: 1530 - DNA, 500 bp, Homo sapiens
ataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacattttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagttttgtattaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcac

SEQ ID NO: 1531 - DNA, 36 bp, Homo sapiens
ctctggtgccccctccagcctgtagcagccatgatg

SEQ ID NO: 1532 - DNA, 36 bp, Homo sapiens
tcaaagcagctgcctcagctcacatccttagagctg

SEQ ID NO: 1533 - DNA, 500 bp, Homo sapiens
atttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgg

SEQ ID NO: 1534 - DNA, 36 bp, Homo sapiens
gtcttcaaggagctggaggtggccgaccagatgacg

SEQ ID NO: 1535 - DNA, 36 bp, Homo sapiens
ctgacctcaggtgatccaccttcctcggcctcccaa

SEQ ID NO: 1536 - DNA, 36 bp, Homo sapiens
cattccgatcatgggcaggtaggttactctacattg

SEQ ID NO: 1537 - DNA, 36 bp, Homo sapiens
gaagcatgtgaagacaaggccaatcttcatgctctc

SEQ ID NO: 1538 - DNA, 36 bp, Homo sapiens
ttggaaaagtggcacagggtaacttcttatttgaat

SEQ ID NO: 1539 - DNA, 36 bp, Homo sapiens
cagattaacaccaagcaggttcatgaaagccttaag

SEQ ID NO: 1540 - DNA, 499 bp, Homo sapiens
ttatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaag

SEQ ID NO: 1541 - DNA, 500 bp, Homo sapiens
gaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaa

SEQ ID NO: 1542 - DNA, 500 bp, Homo sapiens
tactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaa

SEQ ID NO: 1543 - DNA, 500 bp, Homo sapiens
tacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcat

SEQ ID NO: 1544 - DNA, 88 bp, Homo sapiens
atgatacaccaatgtgccgtatactccttcgcaaagaagttctaagattagtcattaatttgagtagttcagtttcaactaaatgtca

SEQ ID NO: 1545 - DNA, 496 bp, Homo sapiens
gtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtca

SEQ ID NO: 1546 - DNA, 36 bp, Homo sapiens
caataatgaaggttcatcgtaagagtcaaccaacca

SEQ ID NO: 1547 - DNA, 36 bp, Homo sapiens
gagttacctagcggacaatgatggagagatctatga

SEQ ID NO: 1548 - DNA, 36 bp, Homo sapiens
gctggaaatctagatgaggaacaagacagtgaagga

SEQ ID NO: 1549 - DNA, 36 bp, Homo sapiens
tctgggtttcttttctagccacagtcagagtggaag

SEQ ID NO: 1550 - DNA, 444 bp, Homo sapiens
acaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcat

SEQ ID NO: 1551 - DNA, 36 bp, Homo sapiens
cactggagcaggccaaagattcggaacaccagccag

SEQ ID NO: 1552 - DNA, 359 bp, Homo sapiens
gaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgacta

SEQ ID NO: 1553 - DNA, 481 bp, Homo sapiens
agggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagtt

SEQ ID NO: 1554 - DNA, 144 bp, Homo sapiens
caaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtca

SEQ ID NO: 1555 - DNA, 500 bp, Homo sapiens
ccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtca

SEQ ID NO: 1556 - DNA, 117 bp, Homo sapiens
gaggcaccacctttgctgttcagcgatgaagaagagaaggaggcacaacttggagtgaagtctgtggataagaaggttgagagtgccaaggagtcattaaaatttgggagaactgat

SEQ ID NO: 1557 - DNA, 500 bp, Homo sapiens
gcccatcacagtgacaatgaacaaaaccagcacaccacacaaatgagtgatgaggaagaggatgatgatggctgtgacctttttgctgactctgagaaggaggaggaagatattgaggacattgaagaaaatactagacctaaaagaagcagacctacatcgtttgcagatgagctggctgcccgcatcaagggggatgccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctgg

SEQ ID NO: 1558 - DNA, 500 bp, Homo sapiens
ccatgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtggcggcaaggggctatttgatgatgaggacgaggagagtgacctcttcacggaagcctcccaggatcggcaagctggagcctctgttaaggaggagtcttcatcatccaaacctggaaagaaaatcccagcaggagctgtttctgtatttttaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccac

SEQ ID NO: 1559 - DNA, 75 bp, Homo sapiens
agtgcagtggcacgatctcggttcactgcaacctccgccttccaggttcaagcaattcttctgcctcagcctccc

SEQ ID NO: 1560 - DNA, 144 bp, Homo sapiens
gcacaggctggagtgcagtggcatgatctcaggtctctgcaacttctgcctcccaggttcaaggaatcctccctcctcagcctcctgagtagctgggattacaggtgtatgccaccacacctgtctaatttttgtatttttagt

SEQ ID NO: 1561 - DNA, 36 bp, Homo sapiens
cgatctacccgcctcggcctcctgagtagctgggac

SEQ ID NO: 1562 - DNA, 36 bp, Homo sapiens
gtctctcaggacaagcaggagcctgctgcaggcctg

SEQ ID NO: 1563 - DNA, 36 bp, Homo sapiens
tttcctatctctccacagtccgaatctgctccaagt

SEQ ID NO: 1564 - DNA, 36 bp, Homo sapiens
ctcaggaggctgaggcaggagaattacttgaacttg

SEQ ID NO: 1565 - DNA, 500 bp, Homo sapiens
gggggggggggtgcggggcacggagtctagcacggggcccaggctagagtgcagtggcgtgagctcactacaatctctggcttctggttcaagtgagtctcctgcctcagcctccccagtagctgggatcacaggtgcccaccaccatgccaggctaatttttgtatttttagtagagatggggtttcgccatgttggccaggctggtctcgaactcctgaccttaagtgatccgcccgcctcagcctcccaaagtgctggaattacaggcatgagccactatgcccagccacattcttaaccttaaagggctctcaatatggagatagaacactggagtcgaagtcccagccccctctgtcgctctctctgaagctcagtgttgtcatttgcaagatgaggacaatatagcatgcaacctcaccttcagaaaagactccatggactttgaggccagagagttgctccggaacagggtgttggtcttttgttacttggtc

SEQ ID NO: 1566 - DNA, 294 bp, Homo sapiens
tctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcag

SEQ ID NO: 1567 - DNA, 36 bp, Homo sapiens
tgatgtcttttttggcagtgcacagccagagaacaa

SEQ ID NO: 1568 - DNA, 500 bp, Homo sapiens
ccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctactggcgcaactacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggt

SEQ ID NO: 1569 - DNA, 339 bp, Homo sapiens
gccgtgttccgtgtgggaagcttgttgcaagaaggttgtgggaaaatcagcaagctctatggagacctgaagcatctgaagacgtttgaccggggaatggtctggaacacggacctggtggagaccctggagctgcagaacctgatgctatgtgcgctgcagaccgtcaatggagcagaggcggggaaggagtcacggggcgcgcacgccggggaagactacaaggtgcggattgatgagtacgatcactccaagcccatccaggggcaacagaagaagccctttgaggagcactggaggaagcacaccctgtcctatgtggacgtcagcactgggaag

SEQ ID NO: 1570 - DNA, 346 bp, Homo sapiens
ttactgtgtgagctccgccccctgccagagcattactgtgagctgcaccccctgccagagcattactgtgtgagctccgccccgtcagagcattactgtgtgagctccgccccctgtcagagcattactgtgtgcgctccgccccctgccagagcattactgtgagctccaccccctgccagagcattactgtgtgagctccgccccctgtcagagcattactgtgtgagctccgccccctgtcagagcattactgtgtgagctccgccccctgtcagagcattactgtgagctccgccccctgtcagagcattactgtgtgagctccgccccctgtcagagcatt

SEQ ID NO: 1571 - DNA, 138 bp, Homo sapiens
cacatcacacacaagaaacagttgtgctcatgtgatgggggcctcagcactaggaaggagtggactgttggcgcacgcagcagcttgaataaatctgaaagtcactacgctgcgtaagagaagccaaataaagcgcat

SEQ ID NO: 1572 - DNA, 500 bp, Homo sapiens
gtgagctccgccccctgccagagcattactgtgagctccgccccctgccagagcattactgtgtgagctccgccccctgccagagcattactgtgtgagctccgccccctgccagagcattactgtgtgagctccgccccgtcagagcattactgtgtgagctccgccccctgtcagagcattactgtgtgagctccgccccctgtcagagcattactgtgtgcgctccgccccctgccagagcattactgtgagctccaccccctgccagagcattactgtgtgagctccgccccctgtcagagcattactgtgtgagctccgccccctgtcagagcattactgtgtgagctccgccccctgtcagagcattactgtgagctccgccccctgtcagagcattactgtgtgagctccgccccctgtcagagcattactgtgtgagctccgccccctgccagagcattactgtgtgagctccgtcccctgccagagtatta

SEQ ID NO: 1573 - DNA, 500 bp, Homo sapiens
acctggtggagaccctggagctgcagaacctgatgctatgtgcgctgcagaccgtcaatggagcagaggcggggaaggagtcacggggcgcgcacgccggggaagactacaaggtgcggattgatgagtacgatcactccaagcccatccaggggcaacagaagaagccctttgaggagcactggaggaagcacaccctgtcctatgtggacgtcagcactgggaaggtcactgtggaatatagacccataatcgacaaaactttgaatgaggctgactgtgccactgtccccccagccattcactcctactgatgagacaagatgcggtgatgacagaatcagctttttgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaag

SEQ ID NO: 1574 - DNA, 78 bp, Homo sapiens
gatcactccaagcccatccaggggcaacagaagaagccctttgaggagcactggaggaagcacaccctgtcctatgtg

SEQ ID NO: 1575 - DNA, 85 bp, Homo sapiens
gccaggctggagtacagtggcaccatcttggctcactgcaacttccgcctcctgggttcaaacgattcttctgcctcagcatccc

SEQ ID NO: 1576 - DNA, 36 bp, Homo sapiens
aggtcttcctcctgcctggcacccacacgctgcagc

SEQ ID NO: 1577 - DNA, 26 bp, Homo sapiens
ccatggctcctgttcatctgcccttg

SEQ ID NO: 1578 - DNA, 36 bp, Homo sapiens
caacatccagaagcttcggcaggaatttgagtcaga

SEQ ID NO: 1579 - DNA, 500 bp, Homo sapiens
cggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacat

SEQ ID NO: 1580 - DNA, 99 bp, Homo sapiens
atccagttagtgaggaacggagccaagctgagcagccttcctcaaatccctactcccactttacctccacccccatcagagacagacttcatgcttcag

SEQ ID NO: 1581 - DNA, 500 bp, Homo sapiens
actggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccc

SEQ ID NO: 1582 - DNA, 498 bp, Homo sapiens
gagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccacttta

SEQ ID NO: 1583 - DNA, 500 bp, Homo sapiens
cattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcct

SEQ ID NO: 1584 - DNA, 500 bp, Homo sapiens
gtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgca

SEQ ID NO: 1585 - DNA, 96 bp, Homo sapiens
tcctgcagagtttaatttggatcttggtttgattcgtatgactgaggaatttcgggaagtagctagtcaactaggatatgaaaaacacgtcagcct

SEQ ID NO: 1586 - DNA, 36 bp, Homo sapiens
agatcgggagttcaagaccagtctggccaacatggt

SEQ ID NO: 1587 - DNA, 36 bp, Homo sapiens
taggattacaggcatgagccactgtgcctggcagca

SEQ ID NO: 1588 - DNA, 66 bp, Homo sapiens
ccccatgctggtcttgaactcctaagctcaagcaatctgcccacctcgacctcccaaagtgctggg

SEQ ID NO: 1589 - DNA, 36 bp, Homo sapiens
ccatccacagacacccaggtgcagccaaagctgcag

SEQ ID NO: 1590 - DNA, 36 bp, Homo sapiens
ttttgttttgtttgacagcctgggttggtggtttta

SEQ ID NO: 1591 - DNA, 68 bp, Homo sapiens
taatcccagctacttgggaggcagaggcaggagaatcgtttgaacctgggaagcggaggttgcagtga

SEQ ID NO: 1592 - DNA, 36 bp, Homo sapiens
ctattcttcagtctccaggtgattggatgtgtccag

SEQ ID NO: 1593 - DNA, 36 bp, Homo sapiens
atccacagatgcaacaaggtaagaaagttgtttgta

SEQ ID NO: 1594 - DNA, 116 bp, Homo sapiens
gacaagctctgggaacagatttatgccacagcaaaatagcccagtgcctagtccatacgccccacaaagccctgcaggatacatgccatattcccatccttcaagttacacaacac

SEQ ID NO: 1595 - DNA, 500 bp, Homo sapiens
ctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgtt

SEQ ID NO: 1596 - DNA, 500 bp, Homo sapiens
ggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaatt

SEQ ID NO: 1597 - DNA, 36 bp, Homo sapiens
tacctgtgcaacgcccagatcaccatgctgcagatg

SEQ ID NO: 1598 - DNA, 334 bp, Homo sapiens
ggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcct

SEQ ID NO: 1599 - DNA, 75 bp, Homo sapiens
tatggacctctcatgctggtcttcactctggttgctatcctactccatgggatgaagacgtctgacactattatc

SEQ ID NO: 1600 - DNA, 49 bp, Homo sapiens
ttggctgatatggccagacctgcagaaaaacttagcacagctcaatctg

SEQ ID NO: 1601 - DNA, 36 bp, Homo sapiens
gagagcctgtggtgccaggtgacagtgaagctccct

SEQ ID NO: 1602 - DNA, 36 bp, Homo sapiens
gagagaattctgagcagggtaggtgggtagtggtgg

SEQ ID NO: 1603 - DNA, 363 bp, Homo sapiens
cttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgac

SEQ ID NO: 1604 - DNA, 500 bp, Homo sapiens
gatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgt

SEQ ID NO: 1605 - DNA, 500 bp, Homo sapiens
ttagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatga

SEQ ID NO: 1606 - DNA, 500 bp, Homo sapiens
gtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtact

SEQ ID NO: 1607 - DNA, 36 bp, Homo sapiens
caattcacgtactttcaggtaataaaaataatgcct

SEQ ID NO: 1608 - DNA, 36 bp, Homo sapiens
atcttccgcctcgcccggactccgggaatgaatttt

SEQ ID NO: 1609 - DNA, 171 bp, Homo sapiens
aatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcga

SEQ ID NO: 1610 - DNA, 500 bp, Homo sapiens
agccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaa

SEQ ID NO: 1611 - DNA, 500 bp, Homo sapiens
caaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacag

SEQ ID NO: 1612 - DNA, 500 bp, Homo sapiens
ctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaa

SEQ ID NO: 1613 - DNA, 500 bp, Homo sapiens
agaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaat

SEQ ID NO: 1614 - DNA, 500 bp, Homo sapiens
agcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggt

SEQ ID NO: 1615 - DNA, 500 bp, Homo sapiens
gaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagta

SEQ ID NO: 1616 - DNA, 36 bp, Homo sapiens
aggacgatacacatgaagccagtgatgatcagccag

SEQ ID NO: 1617 - DNA, 36 bp, Homo sapiens
attagcccacaggccaagcaatggttcagcatgtat

SEQ ID NO: 1618 - DNA, 500 bp, Homo sapiens
gtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggc

SEQ ID NO: 1619 - DNA, 500 bp, Homo sapiens
gaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaag

SEQ ID NO: 1620 - DNA, 500 bp, Homo sapiens
aggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctatggatgttgatgtagaagattattacccagctttcctggacatggtgcggagcctgctggatggcaacatagactcatcacagtatgaagattcactgagagagatgttcaccattcatgcctacattgcctttaccatggacaaactgatc

SEQ ID NO: 1621 - DNA, 99 bp, Homo sapiens
catggcatccagccacagcctcaaccaccaccccaacatccttcccagccttcagcccagtcagccccagctcctgcccagccagctcctcagccccca

SEQ ID NO: 1622 - DNA, 99 bp, Homo sapiens
tttaatcatgccatcaactatgttaataagatcaagaacagatttcagggccaaccagacatctacaaagcattcctggagattttgcacacatatcag

SEQ ID NO: 1623 - DNA, 36 bp, Homo sapiens
acggccccatccttgcagaacaatcaacctgtggag

SEQ ID NO: 1624 - DNA, 500 bp, Homo sapiens
agctccggcagtcatgggcccgctatagcagcagttcatagcagccatcatcacccaacagcggtgcagccccacggaggccaggtggtccagagtcatgctcatccagccccaccagttgcaccagtgcagggacagcagcaatttcagaggctgaaggtggaggatgcgctatcttatcttgaccaggtgaagctgcagtttggtagtcagcctcaggtctacaatgatttccttgacatcatgaaggaatttaaatctcagagcatcgacaccccaggagtgattagtcgtgtgtcccagctattcaaaggccaccccgatctgataatgggattcaacaccttcttgccccctggctacaaaattgaggtgcaaaccaatgacatggtgaatgtgacaactcctggccaggttcatcagattcccacccatggcatccagccacagcctcaaccaccaccccaacatccttcccagccttcagcccagtcagcccc

SEQ ID NO: 1625 - DNA, 141 bp, Homo sapiens
agctccggcagtcatgggcccgctatagcagcagttcatagcagccatcatcacccaacagcggtgcagccccacggaggccaggtggtccagagtcatgctcatccagccccaccagttgcaccagtgcagggacagcag

SEQ ID NO: 1626 - DNA, 500 bp, Homo sapiens
attattacccagctttcctggacatggtgcggagcctgctggatggcaacatagactcatcacagtatgaagattcactgagagagatgttcaccattcatgcctacattgcctttaccatggacaaactgatccagagcattgtcagacagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaatgtcagatgagaattgctttaagcttatgtttattcagagccaaggccaggtccagctgactattgagcttctggacacagaagaggagaattcggatgaccctgtggaagcagagcgctggtcagactacgtggagcgatacatgaattcagatactacctcgcctgagcttcgtgaacatctagcacagaaacca

SEQ ID NO: 1627 - DNA, 102 bp, Homo sapiens
aggctagagtgcagtggcacaatctcagctcactgcaacctccacctcccaggttcaagcgattctcctgcctcagcctcctgagtagctgggattacaggc

SEQ ID NO: 1628 - DNA, 36 bp, Homo sapiens
aggagcctccacaaattgacgcagtaaaacgcagga

SEQ ID NO: 1629 - DNA, 360 bp, Homo sapiens
aacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagc

SEQ ID NO: 1630 - DNA, 273 bp, Homo sapiens
ccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtcc

SEQ ID NO: 1631 - DNA, 500 bp, Homo sapiens
aaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagtcccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagag

SEQ ID NO: 1632 - DNA, 36 bp, Homo sapiens
gtattctttcttttacaggttaccgcccaagtcctc

SEQ ID NO: 1633 - DNA, 36 bp, Homo sapiens
gcaggcctgtagtcccagctactcaggaggctgagg

SEQ ID NO: 1634 - DNA, 500 bp, Homo sapiens
ggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatga

SEQ ID NO: 1635 - DNA, 103 bp, Homo sapiens
cctccagaagcacctggatacccacagcgaggagccagcctacaggtgtgattttgagaactgcaccttcagtgcccgatccctctgctctatcaagtcccat

SEQ ID NO: 1636 - DNA, 36 bp, Homo sapiens
gatttggttttgttttaggtgttttgctggagatca

SEQ ID NO: 1637 - DNA, 388 bp, Homo sapiens
atgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatg

SEQ ID NO: 1638 - DNA, 500 bp, Homo sapiens
gaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatg

SEQ ID NO: 1639 - DNA, 451 bp, Homo sapiens
ggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctc

SEQ ID NO: 1640 - DNA, 224 bp, Homo sapiens
gtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccc

SEQ ID NO: 1641 - DNA, 36 bp, Homo sapiens
aaacttggagaactccaggtctcacttgccctggaa

SEQ ID NO: 1642 - DNA, 500 bp, Homo sapiens
ctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaat

SEQ ID NO: 1643 - DNA, 459 bp, Homo sapiens
acagataacaaagatttcactggtatcaatactaagttaagtggcaacacccattataccccactttgtgctcctacaagtccaaataaggcactaccagaacttaaccaagatgtgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccg

SEQ ID NO: 1644 - DNA, 500 bp, Homo sapiens
agtctccatttggccccctcaaggtaaccatggagcttattacagataacaaagatttcactggtatcaatactaagttaagtggcaacacccattataccccactttgtgctcctacaagtccaaataaggcactaccagaacttaaccaagatgtgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccg

SEQ ID NO: 1645 - DNA, 500 bp, Homo sapiens
ttgagtcatgcaaagagtatctgcttggagtagtaaaagttccaacaaaagagctgctgatcaagagatctgggatcacaggatggtatcctatcattttaccagaagacgggggcctacctcgtggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgtccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcacc

SEQ ID NO: 1646 - DNA, 500 bp, Homo sapiens
gtggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgtccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctat

SEQ ID NO: 1647 - DNA, 36 bp, Homo sapiens
tggggcttacagtgacggccatgcacctgtttggcc

SEQ ID NO: 1648 - DNA, 500 bp, Homo sapiens
catgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgctcactatctggatagggtagttaaagagggttgccctgggttgtgcaatggcaacggcagatgtaccttagacctgaatggttggcactgcgtctgccagctgggctggagaggagctggctgtgacact

SEQ ID NO: 1649 - DNA, 36 bp, Homo sapiens
gtccaagatgcatgtgctggtcctgtccttcaacaa

SEQ ID NO: 1650 - DNA, 499 bp, Homo sapiens
ttgtgcgtgtgaacactctcaagacctgctccgtttatgtagttatttcaagagacaaggtttctcctatcagggtcgggcttccaggctggatggagtgccctggcgcgatcttggctcaccgcaacctctgcctcctgggttcaagcgattctcctgcttcagccttctgagcagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataagaccagtcacttggctgctcttctgaagaaccaagggaagatctttgcct

SEQ ID NO: 1651 - DNA, 36 bp, Homo sapiens
agctcttcagaaaacgaggtttgagcaatgtttaca

SEQ ID NO: 1652 - DNA, 126 bp, Homo sapiens
atgtttatctgaatccgttgtatttcatgcacgtttgctctgtaaatcccagatccccctcctcaccgccccagtgtttatttacatttccagtttatttatcttccaattttatgttctcccttt

SEQ ID NO: 1653 - DNA, 239 bp, Homo sapiens
actgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccaacctcaggcaatccacccaccttggcctcccaaagtgctgggattacagacatgagccaccgtgcccagccagatcattct

SEQ ID NO: 1654 - DNA, 36 bp, Homo sapiens
actaaagggaacctgaggccttcaaacagtggccga

SEQ ID NO: 1655 - DNA, 500 bp, Homo sapiens
tgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggt

SEQ ID NO: 1656 - DNA, 500 bp, Homo sapiens
ttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaaga

SEQ ID NO: 1657 - DNA, 500 bp, Homo sapiens
ccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagc

SEQ ID NO: 1658 - DNA, 36 bp, Homo sapiens
aaaaacagcagcccaaaggtaagaattctaattgtc

SEQ ID NO: 1659 - DNA, 189 bp, Homo sapiens
atggcggccggcaagagcggcggtagcgcaggggagattacttttctggaagctttggctagatcagagtctaagagagatggaggttttaaaaataattggagctttgatcatgaagaagaaagtgaaggagatacagataaagatgggacaaatctgctcagtgtggatgaagatgaggattctgaa

SEQ ID NO: 1660 - DNA, 392 bp, Homo sapiens
tgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaa

SEQ ID NO: 1661 - DNA, 500 bp, Homo sapiens
attgttgctaatagctctggtgaattcatcttgaagacatatgtaagacgaaacaagtctgaaagttttaaaactttgaaaggcaacccaattggacttaacatgttgagcaacaataagaaattgagtgaaaatatgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggatttgcaaagaaattgcagacaagctat

SEQ ID NO: 1662 - DNA, 500 bp, Homo sapiens
aggattctgaaacctcaaaaggaaaaaagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgagtgaaaatatgcaaaatacgtcattatgttctggaactgtagttcatggtagacgttttcatcatgctcatgcacagataccagtagtaaaaacagcagcccaaagcagtctggaccgaaaagaaaggaaagaatacccacctcatgtccaaaaagttgaaattaatcctgtaaggttaagtcggctccaaggtgttgaacgtataatgaagaaaacagaagagtccgaatcacaagtggagcctgaaattaagaggaaagtacaacagaaacggcactgtagtacctatcagcctactcctcctctatctcctgcttcaaaaaaa

SEQ ID NO: 1663 - DNA, 194 bp, Homo sapiens
atgatgatgacaacgacagaactaacagaagagaaagcatatctcctcagcctgctgattcagcatgttcttcccctgcaccatccactggaaaagtagaagcagcactaaatgaaaatacttgcagagcagagcgtgaactacgaagcattccagaagactcagagttaaatacagttacattgccaagaaaa

SEQ ID NO: 1664 - DNA, 500 bp, Homo sapiens
ggactcactccgaggcccttctcggtcaaatgttgtcaaaattttaagagagtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatgtgtcaatagtatctcagattgaccatttctgttacttgtcatttctactttcagaaactaaatgactttcaaatttgggtatagacaataaagaactgaagtgctcacta

SEQ ID NO: 1665 - DNA, 500 bp, Homo sapiens
ggaagttaaaaaaggaagcaaaagaagtttttccaaagatgttatgaagggctctaatccaaaagtaccacagcaaaacaacttcagtgactgtggtgtatatgtattgcagtatgtagagagcttttttgagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatgtgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtatta

SEQ ID NO: 1666 - DNA, 500 bp, Homo sapiens
gaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatgtgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttatag

SEQ ID NO: 1667 - DNA, 500 bp, Homo sapiens
aagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgcc

SEQ ID NO: 1668 - DNA, 500 bp, Homo sapiens
aacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccgg

SEQ ID NO: 1669 - DNA, 169 bp, Homo sapiens
ttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctccc

SEQ ID NO: 1670 - DNA, 36 bp, Homo sapiens
gacccagctattgttcagtcctcactaggctcatcg

SEQ ID NO: 1671 - DNA, 25 bp, Homo sapiens
aggctcatcgacttcttcattccag

SEQ ID NO: 1672 - DNA, 102 bp, Homo sapiens
gctcatcgacttcttcattccagtccatgggttcttatggacctttcggcaggatgcccacatacagtcagttcagtccgagttccttagttgggcagcagt

SEQ ID NO: 1673 - DNA, 505 bp, Homo sapiens
ccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaa

SEQ ID NO: 1674 - DNA, 25 bp, Homo sapiens
tactcatgcctcagccttccaagta

SEQ ID NO: 1675 - DNA, 36 bp, Homo sapiens
atcccagctacttgggaggctgaggcaggagaattg

SEQ ID NO: 1676 - DNA, 351 bp, Homo sapiens
taatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaa

SEQ ID NO: 1677 - DNA, 500 bp, Homo sapiens
aaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataat

SEQ ID NO: 1678 - DNA, 36 bp, Homo sapiens
gaaacccatcctcgacaggccaaccaggatctccca

SEQ ID NO: 1679 - DNA, 66 bp, Homo sapiens
gggggggggggaggagggaaagcggcgagtaagatggaagatgaggaggtcgctgagagctgggaa

SEQ ID NO: 1680 - DNA, 500 bp, Homo sapiens
acccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaag

SEQ ID NO: 1681 - DNA, 500 bp, Homo sapiens
aaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccag

SEQ ID NO: 1682 - DNA, 36 bp, Homo sapiens
aagaaatgggcacaacaggtggagaaggaaagggag

SEQ ID NO: 1683 - DNA, 500 bp, Homo sapiens
aggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtct

SEQ ID NO: 1684 - DNA, 278 bp, Homo sapiens
aacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtg

SEQ ID NO: 1685 - DNA, 229 bp, Homo sapiens
ccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaag

SEQ ID NO: 1686 - DNA, 66 bp, Homo sapiens
acctcacagctggaggctttccaggccaaaatgaagagggtggaggagtccattctgagccgaaac

SEQ ID NO: 1687 - DNA, 36 bp, Homo sapiens
atcaacaccgatgcaaagttccaggtattcctgaag

SEQ ID NO: 1688 - DNA, 36 bp, Homo sapiens
ttgtttggaggtgttgatcttcttgtagaaattctt

SEQ ID NO: 1689 - DNA, 204 bp, Homo sapiens
ttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccac

SEQ ID NO: 1690 - DNA, 36 bp, Homo sapiens
tgtgctggctgtgacgagctgatattcagcaatgag

SEQ ID NO: 1691 - DNA, 36 bp, Homo sapiens
tttttattttgagcaattctcctgcctcagcctccc

SEQ ID NO: 1692 - DNA, 36 bp, Homo sapiens
tcctgacctcagatgatccgcctgccttggcctccc

SEQ ID NO: 1693 - DNA, 36 bp, Homo sapiens
tttttattttgagcaattcgcctgccttggcctccc

SEQ ID NO: 1694 - DNA, 311 bp, Homo sapiens
atctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctc

SEQ ID NO: 1695 - DNA, 500 bp, Homo sapiens
acaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagca

SEQ ID NO: 1696 - DNA, 89 bp, Homo sapiens
gagtcgaaggactagaatgagatcactgaactcatttcacttgttgcttacggtacagtccagcatgagctggaaatgtaggaacctca

SEQ ID NO: 1697 - DNA, 500 bp, Homo sapiens
gtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttcc

SEQ ID NO: 1698 - DNA, 173 bp, Homo sapiens
cttcctattacctatttcacagatggagtttcactcttgttgctcaggctggagtgcaatggcacgatctcggctcaccacaacctccgcctcccgggttcaagggattctcctgcctcagcttcccgagtagctgggattacagcataagcctacagggtacgaagaatgaa

SEQ ID NO: 1699 - DNA, 79 bp, Homo sapiens
aggacttctggctgactgctgcccgcaacgttctcaagctggtggtgaagtctgagtggaagtcataccctattcaggc

SEQ ID NO: 1700 - DNA, 36 bp, Homo sapiens
ctctggaccctgactcgggcctcctttcatgtactc

SEQ ID NO: 1701 - DNA, 36 bp, Homo sapiens
ggagtgtgtgtgactttgggtttgcagttacagcgc

SEQ ID NO: 1702 - DNA, 36 bp, Homo sapiens
atgaaagaggaagaggaggtttttcagcccatgtta

SEQ ID NO: 1703 - DNA, 266 bp, Homo sapiens
aagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaag

SEQ ID NO: 1704 - DNA, 257 bp, Homo sapiens
ccgcaactgaacttgatactgaacctgatgatgaatgggtgaaaaataggaaagatgaaagtcgtgcttttcatgagtgggatgaagatgctgacattgatgaatctgaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatg

SEQ ID NO: 1705 - DNA, 500 bp, Homo sapiens
atggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtgactggtatagtggtcccgcaactgaacttgatactgaacctgatgatgaatgggtgaaaaataggaaagatgaaagtcgtgcttttcatgagtgggatgaagatgctgacattgatgaatctgaagagtctgcggaggaatcaat

SEQ ID NO: 1706 - DNA, 284 bp, Homo sapiens
tccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaagcctactactgttgactggaagccttaccaataacataaaacaatcgaataacaattatttcatgtattatatgtaaaatatatata

SEQ ID NO: 1707 - DNA, 198 bp, Homo sapiens
tccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaag

SEQ ID NO: 1708 - DNA, 500 bp, Homo sapiens
aagccttaccaataacataaaacaatcgaataacaattatttcatgtattatatgtaaaatatatatactggattcttacagtaagaatgaatatgaacagttaaattatgcaaaacaactgaaagagagattggaggcttttacaagagattttcttcctcacatgaaagaggaagaggaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaagaagcagaagtgtcagaacactccacaggtataacccatcttcctcctgaggtaatgctgtcaattttcagctatcttaatcctcaagagttatgtcgatgcagtcaagtaagcatgaaatggtctcagctg

SEQ ID NO: 1709 - DNA, 71 bp, Homo sapiens
cgtgatgattgtggcagaagatgtcgagatagaagcccaccgtgtggtcctggcagcctgcagcccctact

SEQ ID NO: 1710 - DNA, 327 bp, Homo sapiens
ctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactg

SEQ ID NO: 1711 - DNA, 36 bp, Homo sapiens
gtgcgtttgcgtcctcagcgtgtgccgcttatggag

SEQ ID NO: 1712 - DNA, 36 bp, Homo sapiens
gtagcagaggagcttgaggcaagtagcaaggggtgt

SEQ ID NO: 1713 - DNA, 36 bp, Homo sapiens
gtactccctccctcccaggtgcccgcccctgcatcc

SEQ ID NO: 1714 - DNA, 36 bp, Homo sapiens
cggcccccctgctgccaggcccacacagctgctgac

SEQ ID NO: 1715 - DNA, 36 bp, Homo sapiens
acatagaatccgatcaaaatcctcacctgatgagaa

SEQ ID NO: 1716 - DNA, 500 bp, Homo sapiens
acatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataaca

SEQ ID NO: 1717 - DNA, 66 bp, Homo sapiens
gatcttggctcactgcagcctccctctgcctcccgggttcaagccatcctcccacctcagcctacc

SEQ ID NO: 1718 - DNA, 197 bp, Homo sapiens
ttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagca

SEQ ID NO: 1719 - DNA, 216 bp, Homo sapiens
aaagtaaatgctgcaccaacttggtgttggaattgcagagaccactgcagtggggagctccaatttccagcctttggcaagggcatattcttcccgaggatcaccctgttgtgctggggcagccttccatgagcacttgcaccccggtgaccctgattgcccagtctcaagggatctgagaaaattaggaaaaccaggaacggttgttgtaatctt

SEQ ID NO: 1720 - DNA, 500 bp, Homo sapiens
gaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacga

SEQ ID NO: 1721 - DNA, 320 bp, Homo sapiens
ctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccag

SEQ ID NO: 1722 - DNA, 36 bp, Homo sapiens
tcttcacacccaccgcaggctccctcaacctcctgg

SEQ ID NO: 1723 - DNA, 36 bp, Homo sapiens
tcaaacatctgacctcaggtgatccgcccgcctcag

SEQ ID NO: 1724 - DNA, 330 bp, Homo sapiens
atcactgagcctttggctgagtctgatacagtccttatatacagacaatttttttttttccttgagacggagtcttactctgttgcccaggctggagtgcaatggcgcaatcttggctcactgcaaccgccgccccccaggttcaagcaattctcctgcctcagcctccagagtagctgggattacaggcatgcgccaccaagcccagctaattttgtatttttagatacagtttcaccatgttggtcagactggtctcgaactcctgacctcaggtgatctgcccacctcagcctcccaaagcgctgggattacaggcgtgagctaccg

SEQ ID NO: 1725 - DNA, 36 bp, Homo sapiens
cgaccccgttctgcggccgttgagtagttttcaatt

SEQ ID NO: 1726 - DNA, 285 bp, Homo sapiens
cggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggat

SEQ ID NO: 1727 - DNA, 244 bp, Homo sapiens
ccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaaga

SEQ ID NO: 1728 - DNA, 280 bp, Homo sapiens
cttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggac

SEQ ID NO: 1729 - DNA, 36 bp, Homo sapiens
ccgccaccctcgctccccgccggcagccggcagcca

SEQ ID NO: 1730 - DNA, 36 bp, Homo sapiens
caaagccatggctggcagtgtcctgttggataaacg

SEQ ID NO: 1731 - DNA, 36 bp, Homo sapiens
aagcagagacacgtccagctgttgggtagatcaatt

SEQ ID NO: 1732 - DNA, 36 bp, Homo sapiens
gacctgacctccattgtggagctggagtggctgctg

SEQ ID NO: 1733 - DNA, 144 bp, Homo sapiens
ggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatg

SEQ ID NO: 1734 - DNA, 100 bp, Homo sapiens
cagagtctcgcttcgtcacccaggctggagtacagtggctcaatctcagctcactgcaacctccacctcccaggttcaagcaattctgcctcaccctccc

SEQ ID NO: 1735 - DNA, 236 bp, Homo sapiens
gtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgag

SEQ ID NO: 1736 - DNA, 500 bp, Homo sapiens
ggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgt

SEQ ID NO: 1737 - DNA, 69 bp, Homo sapiens
cagcccaaccgagtagagatctatgagaagacagtagaggtgctggagccggaggtcaccaagctcatg

SEQ ID NO: 1738 - DNA, 507 bp, Homo sapiens
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatg

SEQ ID NO: 1739 - DNA, 500 bp, Homo sapiens
gaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagc

SEQ ID NO: 1740 - DNA, 500 bp, Homo sapiens
gtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaa

SEQ ID NO: 1741 - DNA, 500 bp, Homo sapiens
ggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccc

SEQ ID NO: 1742 - DNA, 500 bp, Homo sapiens
cagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggac

SEQ ID NO: 1743 - DNA, 499 bp, Homo sapiens
ttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaag

SEQ ID NO: 1744 - DNA, 500 bp, Homo sapiens
gacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggt

SEQ ID NO: 1745 - DNA, 84 bp, Homo sapiens
gacttgaacagactcattacccagcgcatctctgccgccatgtataaatccttggaccaagctatcagccgctttgagagtgag

SEQ ID NO: 1746 - DNA, 500 bp, Homo sapiens
gagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctc

SEQ ID NO: 1747 - DNA, 164 bp, Homo sapiens
gagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgcta

SEQ ID NO: 1748 - DNA, 500 bp, Homo sapiens
gagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgag

SEQ ID NO: 1749 - DNA, 500 bp, Homo sapiens
atagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgcta

SEQ ID NO: 1750 - DNA, 37 bp, Homo sapiens
gatttgctccatgccgcacccttccaaaacatcttgc

SEQ ID NO: 1751 - DNA, 59 bp, Homo sapiens
tccggatgaaacgtctggaagccaagtatgccccgctccacctggtccctctgatcgag

SEQ ID NO: 1752 - DNA, 500 bp, Homo sapiens
gaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaag

SEQ ID NO: 1753 - DNA, 524 bp, Homo sapiens
ggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcacccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcct

SEQ ID NO: 1754 - DNA, 36 bp, Homo sapiens
ccataagcgtccttcagagtgagtccagcaccctac

SEQ ID NO: 1755 - DNA, 36 bp, Homo sapiens
ccaccattgaagtgaaagccgctcctgacatcactg

SEQ ID NO: 1756 - DNA, 312 bp, Homo sapiens
ccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggcca

SEQ ID NO: 1757 - DNA, 500 bp, Homo sapiens
cccctccctccctcccctcccttccccgggcccgggtctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggcca

SEQ ID NO: 1758 - DNA, 496 bp, Homo sapiens
gaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacaggtatatacagcatataaatatatatatatat

SEQ ID NO: 1759 - DNA, 500 bp, Homo sapiens
ctggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacaggtatatacagcatataaatatatatatatatatatttatatttttgggggtgggagaaatccaaaataaagtaaatgcttgtttcatttttaagctgctgatattcattccttattgtatgttgtcag

SEQ ID NO: 1760 - DNA, 36 bp, Homo sapiens
tggtgcttaccgagttaggtctggctctgggagagg

SEQ ID NO: 1761 - DNA, 89 bp, Homo sapiens
gtctcacctcatcagtgtgcatagtggcagaaattataaagaaggttgaaaggagcagggaaaagatccagaagcatgttagttcgaca

SEQ ID NO: 1762 - DNA, 36 bp, Homo sapiens
gcttgctgcagaggccagagctattaagaatggcaa

SEQ ID NO: 1763 - DNA, 441 bp, Homo sapiens
cgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggt

SEQ ID NO: 1764 - DNA, 500 bp, Homo sapiens
tacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaagga

SEQ ID NO: 1765 - DNA, 500 bp, Homo sapiens
accaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgt

SEQ ID NO: 1766 - DNA, 36 bp, Homo sapiens
agtgtccccggcaagaagaggctgcctaccacaagg

SEQ ID NO: 1767 - DNA, 25 bp, Homo sapiens
ccaatgttggagccgtctgcaaagt

SEQ ID NO: 1768 - DNA, 36 bp, Homo sapiens
ctatgacatagcagcacggtaatgatgacattttca

SEQ ID NO: 1769 - DNA, 454 bp, Homo sapiens
cattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaaaattattgctgtgcacccacatttcgtgagatccagttgcaagcagtttgtgaccggagggaagaagctgctactgtttgaacggtcttggatgaacagatggaagtctgctgttctgcatgaaggggaagggaacataaggagtgtgaagtggagaggccatctgattgcttgggccaataatatgggtgtgaagatttttgacatcatctcaaagcaaagaatcaccaatgtgccccgggatgatataagtcttc

SEQ ID NO: 1770 - DNA, 36 bp, Homo sapiens
aaagccgcccctcagcccttgaatctggtatcaagt

SEQ ID NO: 1771 - DNA, 36 bp, Homo sapiens
ttgtttttttccttgcagttgaatctggtatcaagt

SEQ ID NO: 1772 - DNA, 450 bp, Homo sapiens
cttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgc

SEQ ID NO: 1773 - DNA, 135 bp, Homo sapiens
agtccttcctcacactgccgccagcctgggagccctgagagccagcaggcttccaagcgcctgtagtttctcccttacaaactctcaactttcttccgttgtgtgaaaattgcctctcccgccccaaagctttgc

SEQ ID NO: 1774 - DNA, 52 bp, Homo sapiens
tgcgctggacgatagaagtacagcccaatgtagagtacaaatgcaggttgta

SEQ ID NO: 1775 - DNA, 48 bp, Homo sapiens
cgcctgcaagccatgatgacccacctgcatgtgaagtctacagaaccc

SEQ ID NO: 1776 - DNA, 165 bp, Homo sapiens
ttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatg

SEQ ID NO: 1777 - DNA, 36 bp, Homo sapiens
atgtggacgagtctgcctgtccttatgttatggcca

SEQ ID NO: 1778 - DNA, 36 bp, Homo sapiens
tctgagtatgatgccaagtcagatatgtacagcttg

SEQ ID NO: 1779 - DNA, 98 bp, Homo sapiens
tcaaaatggggctgctgtcttctttcacttgtagtgacgagtttagctcattgagactacatcacaacagagctattactcacttaatgaggtctgct

SEQ ID NO: 1780 - DNA, 304 bp, Homo sapiens
ctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgtt

SEQ ID NO: 1781 - DNA, 123 bp, Homo sapiens
aaatccaggtgttaaaagaacccctacaacagccaaccttcccttttgcagttgcaaaccaactcttgctggtttctttgctggagcacttgagccacgtgcatgaaccaaacccacttcgtt

SEQ ID NO: 1782 - DNA, 500 bp, Homo sapiens
agttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggcc

SEQ ID NO: 1783 - DNA, 500 bp, Homo sapiens
atgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaatt

SEQ ID NO: 1784 - DNA, 36 bp, Homo sapiens
gaggcccgcgcccggacggtcctcagccctcgctct

SEQ ID NO: 1785 - DNA, 500 bp, Homo sapiens
agcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagcta

SEQ ID NO: 1786 - DNA, 36 bp, Homo sapiens
gcactttgggaggctgaggcaggagaatcgcttgag

SEQ ID NO: 1787 - DNA, 36 bp, Homo sapiens
ctgaaggccatcagcaagctggtgaggcagtgcaac

SEQ ID NO: 1788 - DNA, 105 bp, Homo sapiens
ttgcctaggctggtctcgaactcctgggctcaagcaatcctcgtgcctgagcctcccagaatactgggattacatgtgtgaaccaaatgttctgaatttatctag

SEQ ID NO: 1789 - DNA, 500 bp, Homo sapiens
taggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaatt

SEQ ID NO: 1790 - DNA, 390 bp, Homo sapiens
gtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagta

SEQ ID NO: 1791 - DNA, 500 bp, Homo sapiens
cagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtga

SEQ ID NO: 1792 - DNA, 500 bp, Homo sapiens
catggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggctt

SEQ ID NO: 1793 - DNA, 72 bp, Homo sapiens
acaccacgctgccttcaactagtgcctggtcatccattcgtgcctccaactacaacgttcccctcagcagta

SEQ ID NO: 1794 - DNA, 500 bp, Homo sapiens
aaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagta

SEQ ID NO: 1795 - DNA, 36 bp, Homo sapiens
aagatagacttaccagaggtgcaaattgagcatgac

SEQ ID NO: 1796 - DNA, 36 bp, Homo sapiens
ttagtcgggtaggcataggattggattcagcatcaa

SEQ ID NO: 1797 - DNA, 151 bp, Homo sapiens
ggggcaacaactacccacagattgtgttggctccaggcctttgtcattaaatctgtactaaataaatacaagcagctccagcttattggggctgcgttctctcttcggcgtctctaaggccgagcagtttcctagctgcgctcacgcaaaa

SEQ ID NO: 1798 - DNA, 26 bp, Homo sapiens
taatcctcctgcctcggcctcctaag

SEQ ID NO: 1799 - DNA, 100 bp, Homo sapiens
aaagagggctgctcaactgcaaggacgctgtaagcaggaagagaagccacagcgcttcagaaaagagtgggacagggacaagcatatctaagaggctgaa

SEQ ID NO: 1800 - DNA, 500 bp, Homo sapiens
aaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagacca

SEQ ID NO: 1801 - DNA, 36 bp, Homo sapiens
tatcgagatcctggaccggcaccctttcttgggccg

SEQ ID NO: 1802 - DNA, 126 bp, Homo sapiens
gtttaatcaagacaggatctcactatgttgcccaggcttgtctcaaattcctggactcaagccatcctcctgcctcggcctcccaaagtgctgggattacaggcataagccactgccccggcctag

SEQ ID NO: 1803 - DNA, 36 bp, Homo sapiens
attggaccttgtgaaggaatcagcatgggagatcat

SEQ ID NO: 1804 - DNA, 500 bp, Homo sapiens
tgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgcc

SEQ ID NO: 1805 - DNA, 36 bp, Homo sapiens
aggagttgctgagtacagagcctctgagggtaagac

SEQ ID NO: 1806 - DNA, 500 bp, Homo sapiens
ctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccc

SEQ ID NO: 1807 - DNA, 36 bp, Homo sapiens
acactactcctgaggatgctactcccgagcccggag

SEQ ID NO: 1808 - DNA, 36 bp, Homo sapiens
attcgagatgagtttctgaggatcagcactgccagt

SEQ ID NO: 1809 - DNA, 36 bp, Homo sapiens
ggatccagtgcttcaacgatgtgactgccatcatct

SEQ ID NO: 1810 - DNA, 26 bp, Homo sapiens
ggctgcgcaccatctctgtgatcctg

SEQ ID NO: 1811 - DNA, 36 bp, Homo sapiens
catctctgtgatcctgttcctcaacaagcaagatct

SEQ ID NO: 1812 - DNA, 500 bp, Homo sapiens
tcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagt

SEQ ID NO: 1813 - DNA, 95 bp, Homo sapiens
tgtgatcctgttcctcaacaagcaagatctgctcgctgagaaagtccttgctgggaaatcgaagattgaggactactttccagaatttgctcgct

SEQ ID NO: 1814 - DNA, 500 bp, Homo sapiens
aggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaat

SEQ ID NO: 1815 - DNA, 500 bp, Homo sapiens
ggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgct

SEQ ID NO: 1816 - DNA, 492 bp, Homo sapiens
ggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 1817 - DNA, 36 bp, Homo sapiens
gatgcaactctctctcaggtaagagcccactgagtc

SEQ ID NO: 1818 - DNA, 36 bp, Homo sapiens
gacatcaatgccatttgcgtgagtctgggtggaggt

SEQ ID NO: 1819 - DNA, 44 bp, Homo sapiens
aggcgtctgaggggcggacggaggcggcggcggcggcggcggga

SEQ ID NO: 1820 - DNA, 246 bp, Homo sapiens
atgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggca

SEQ ID NO: 1821 - DNA, 281 bp, Homo sapiens
actttgggaggccgaggcgggcggatcagaaggtcaagagatcgagaccatcctggccaacatggtgaaaccccgtctctactagaaatacaataattctagctgggcgtggtggcgcgcagctgtagtcccagctacttgggaggctgaggaaggagaatcgcttgaacccgggaggcagcagttgcagtgagccgagatcgcgccactgcattccagcctggcgacagagcgagactccgtctccaaaaaaaaaaaaaaaaaaaaaaaaaaaaaaaggc

SEQ ID NO: 1822 - DNA, 36 bp, Homo sapiens
aggcggcagcgcttctagaaatgctgagccgattat

SEQ ID NO: 1823 - DNA, 500 bp, Homo sapiens
gaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgag

SEQ ID NO: 1824 - DNA, 86 bp, Homo sapiens
gcctaggctggagtgcagtggcacgatcttggcttactgcaacctccgcctcccagattcaagggattctcctgcctcagtctcca

SEQ ID NO: 1825 - DNA, 74 bp, Homo sapiens
gagtgcaatggcatgatctcggctcactgaaacttccacctcccgggttcaagcgattctcctgcctcagcctc

SEQ ID NO: 1826 - DNA, 456 bp, Homo sapiens
aggctggtcttgaactcctgggctcaagcaatcagcccacctctgcctcccaaagcgttgagattacaagcgtgagccaccattcctggaccctcgtagtttttctggagcctcgtgatttgatatgatcttcctgccgctgattcctcacagtattggcttgccacacctccaggggcactgatcacattctacctggcattatttcatctgagtccctgtcctagcccttctgcccattagactgtaaccttgtttagggaaagatctgtgtcttactcatctgtgattttgttgttgttgttgttttgagacagggtcttgccctgttgcccaggctggagagcagtggtgcaatcttggctcactgcagcctcaacctgttggggtcaagccatcctcccacctcagctttccaagtagctgagactacaggcctgtgccaccacacccagc

SEQ ID NO: 1827 - DNA, 36 bp, Homo sapiens
atcttcagcacctcctgcctcttcctcaagctcctt

SEQ ID NO: 1828 - DNA, 36 bp, Homo sapiens
caccttcgccgtgctgtcctccgtgagcaccatccg

SEQ ID NO: 1829 - DNA, 156 bp, Homo sapiens
tgcaaaccatcaccaatgagaacccatcgggaccgagcttggggaccatcccgcaagcccacttcctcctggtgatgctcagcatgctcaccctgcagcacagcgcaaacaaccttgacctcctgctcaattccggcacgctggccctcgctcaga

SEQ ID NO: 1830 - DNA, 152 bp, Homo sapiens
ttgaggaagatatgaatgcttctgctcaaggtgcttctgccacagttttggaagaaacaaggaaggaaacggctcctgtgcagctccctgtttcagggccagaactggctgccatgatgaagattggaacaagggtcatgagaggtgtggac

SEQ ID NO: 1831 - DNA, 1367 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaaaaaaaaaaa

SEQ ID NO: 1832 - DNA, 36 bp, Homo sapiens
atgataatatcaagacacctgccgagcgtctgcggg

SEQ ID NO: 1833 - DNA, 64 bp, Homo sapiens
ggatgataatctcaagacacctcctgagtgtctgctcactccccttccaccctcagcggatgat

SEQ ID NO: 1834 - DNA, 233 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaag

SEQ ID NO: 1835 - DNA, 142 bp, Homo sapiens
gaggcagaaaaaccacgcaaacccaagaggcagagggcggctgagaaccacccccaagaggcggagggattacccgaacccaagaggcggaggttgagctgagaagaggccagtgcactcaagcctgagcaataagaataaa

SEQ ID NO: 1836 - DNA, 36 bp, Homo sapiens; identical to SEQ ID NO: 1832

SEQ ID NO: 1837 - DNA, 377 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagctccccttccaccctctccccttccaccctcagcggatgataatctcaaggagtgtctctccccttccaccctcagcggatgataatctcaagacacctcccttagctactcaggaggctgaggcagaaaaaccacgcaaaccc

SEQ ID NO: 1838 - DNA, 36 bp, Homo sapiens
tccccatacctgagctcgctggcctcctcccgctac

SEQ ID NO: 1839 - DNA, 325 bp, Homo sapiens
ctgggagaacagctgaagcagctggtgcctgcgagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgccca

SEQ ID NO: 1840 - DNA, 500 bp, Homo sapiens
cccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggtgagtgagtgcagacagatggggcctggtgcccttgagcagttcccaggtctcagctgccacacatctcacagcgggtgatgctgggggaagcttacgcagtcacagtactggattcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggttatttattatcttgccaagtttaggctgggcatggtgactcatgcctgtaatcccagcattttgggaggctgaggctg

SEQ ID NO: 1841 - DNA, 36 bp, Homo sapiens
cacctgtgccctgcccaggcattgacaagctgaccg

SEQ ID NO: 1842 - DNA, 36 bp, Homo sapiens
acagggacctcctgtgaggcgtgtgcgcacaacacc

SEQ ID NO: 1843 - DNA, 36 bp, Homo sapiens
tggaaacagattgtgtttgaatctttattaaaagaa

SEQ ID NO: 1844 - DNA, 36 bp, Homo sapiens
gagtcgctgggattgcaggtacacaccactacaact

SEQ ID NO: 1845 - DNA, 151 bp, Homo sapiens
ttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcat

SEQ ID NO: 1846 - DNA, 36 bp, Homo sapiens
agggccacagagctggagctggatctaccatgaaag

SEQ ID NO: 1847 - DNA, 36 bp, Homo sapiens
gctcttacaaggatccgagtgagtacatcaacccca

SEQ ID NO: 1848 - DNA, 36 bp, Homo sapiens
tttttttgttattaaaagagccacctaagctgaaga

SEQ ID NO: 1849 - DNA, 274 bp, Homo sapiens
gtcacccaggcttgagtacagtagtgctatcacagctcactgcagccttgaactcctgggctaaggatcctcctacctgagcctcctgagtagctaggactggtctccctctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaatttttgtatacgtggattcca

SEQ ID NO: 1850 - DNA, 500 bp, Homo sapiens
agtctcatgttgaagatttttatgtagaaggccttcccaaaggaattttttttttttttttgagatggagttttcactcttatcgcccaggctggggggcaatggcgcaaccttgctggtcactgcaacctctgcctcctgggttcaagaaattctcctgccttagcctcccaagtcactgggattacaggtgcccaccaccacacgaggctaatttttgtatttttagtggagatggggtttcaccatgttggccgggccagtctcgaactcctgacgtcaagtgatcttcccgcctcgactcctgacatcaagtgatctttccgcctcggcctcccagagtgctgagattacagacgtgaacccatgcctggccaggaattttgtttttcaggaaggctttctactaatggaattcctggccttgagaggatgttactttcgaaggaaaggatttttttgttattaaaagagccacctaagctgaagattcccttgag

SEQ ID NO: 1851 - DNA, 155 bp, Homo sapiens
aaggctggagtgtagtagtgctatcacagctgactgcagcctcaaccttccaggctgaagcgatcctcccatctcaacctcccacgtggctgagactacaggtgcttgccactatgcccaactaatatttggaatttttgtatacgtggattcca

SEQ ID NO: 1852 - DNA, 500 bp, Homo sapiens
ctctccaggcccagaactttctccagtcagcctctacagaccaagctcatgactcacaatggcctatttaggcccataccctacgtcacggcagtctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgtctcacagcagattcttcaggcccagcatctgcctcactgtggaccccccaagccaagctcccaacctttcagcagcttctacacacccagctcctgccacccagtggcttctttaggccaagctcatgcttcacaagggcctttccaggcccaacttttgt

SEQ ID NO: 1853 - DNA, 36 bp, Homo sapiens
tcgtcggcggccacctcggcctccagctaaaccaga

SEQ ID NO: 1854 - DNA, 36 bp, Homo sapiens; identical to SEQ ID NO: 1853

SEQ ID NO: 1855 - DNA, 223 bp, Homo sapiens
ttctttgactcggaaagggaactccctgaccccttgcgcttcccgagtgaggcaatgcctcgccctgcttcagctcgtgcacggtgcgctgcacccactgtcctgcgccccctgtctggcactccctagtgagatgaaccctcagatggaaatgcagaaatcacccgtcttctgcgtcgctcacgctgggagctgtagaccggagctgttcctattgggccat

SEQ ID NO: 1856 - DNA, 127 bp, Homo sapiens
tttactgcatgcctggagagaacacagcagtaaaaaccaggtttgctactggaaaaagaggaaagagaagactttcattgacggacccagccatggcagcgtagcagccctgcgtttcagacggcag

SEQ ID NO: 1857 - DNA, 36 bp, Homo sapiens
cgcctcgacctcccaaagtgctgggattacagacgt

SEQ ID NO: 1858 - DNA, 36 bp, Homo sapiens
ttgagggttcttgccatggagcctccaaaggccgct

SEQ ID NO: 1859 - DNA, 112 bp, Homo sapiens
ttgcccaggctggtctcgaactcctgtactcaagcaatccacccgcctcagcctcccaaagtgctgagattacaggcgtgagccacttcgcctggcctaggagatacgagtt

SEQ ID NO: 1860 - DNA, 36 bp, Homo sapiens
gcactttgggaggccgaggtgggtggaacacgaggt

SEQ ID NO: 1861 - DNA, 514 bp, Homo sapiens
gttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcatgtgcccatgtggagtgcccgcctgctcacacatgtcgatgcggagtgcccgcctgctcacacatgcccatgtggagtgcccgcctgctcacacgtgcccatgtggagtgcccgcctgctcacacacgtgtccatgtggagtgcccacctgctcatgtgcccatgtggagtgcccacctgctcacatgtgccgatgtggagtgccacctgctcacacacgtgcccatgtggagtgccc

SEQ ID NO: 1862 - DNA, 36 bp, Homo sapiens
ttcccagcatgtggaaatggtccagcctgcaataac

SEQ ID NO: 1863 - DNA, 36 bp, Homo sapiens
aattttgttattttatagaaagtggagaccccgcta

SEQ ID NO: 1864 - DNA, 36 bp, Homo sapiens
ccgcacagccctgcctggaatggctacacccctttg

SEQ ID NO: 1865 - DNA, 36 bp, Homo sapiens
gtggacgccaccacccgggtaaggcaggcagccgga

SEQ ID NO: 1866 - DNA, 36 bp, Homo sapiens
ccaaacgaggtcagctcggtgagtacactctctctc

SEQ ID NO: 1867 - DNA, 36 bp, Homo sapiens
tgctttttctcgttttagttagtcagtgataagcat

SEQ ID NO: 1868 - DNA, 36 bp, Homo sapiens
atgtctcggaagatgaaggggaagaactcatcagct

SEQ ID NO: 1869 - DNA, 36 bp, Homo sapiens
gggggcacagttcctgagccctgtaatcgtggagat

SEQ ID NO: 1870 - DNA, 36 bp, Homo sapiens
attaacacctgtaaccagaatgggttgaatggcttg

SEQ ID NO: 1871 - DNA, 36 bp, Homo sapiens
actcgccctactttttaggttttggctgtcggactg

SEQ ID NO: 1872 - DNA, 36 bp, Homo sapiens
aaggccaaaacgcaaacatggagaatctgtacacag

SEQ ID NO: 1873 - DNA, 36 bp, Homo sapiens
ctagaaacgacaaccaagaaggggaacacggccctg

SEQ ID NO: 1874 - DNA, 417 bp, Homo sapiens
acttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccgg

SEQ ID NO: 1875 - DNA, 36 bp, Homo sapiens
aaccccacacactctgccaggcttcaatcctgcctc

SEQ ID NO: 1876 - DNA, 500 bp, Homo sapiens
tcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatc

SEQ ID NO: 1877 - DNA, 390 bp, Homo sapiens
gggaggcggcgggccctgcccagagcccgtcccgggcgccggcaagcgagctccggccgcggcggcagcgccatcccgggccgcgggcagccgcccctcgccctccgcgtccggaactgccttcgccttcccgcgaccccgcagcagccggccctcggggcgccacgaacgctgtcccctctgtggagcagagacccccttccccttcttagggggtgtcgcctcggggatcgctgagcgctaggggtccaggaggcggggacgggagcgccgtgacccgccatggctcaagcggccaaacagctgaagaaaatcaaagacatcgaggcgcaggccctccaggagcagaaggagaaggaggaatccaacaggaagcggagaaaccgctcc

SEQ ID NO: 1878 - DNA, 385 bp, Homo sapiens
agttttgggaggctgtaccccataaaggaagggtgcaagggcctgtgggctgacaggaattacagaccggcttccaggtggccccaccacctgtgctgggcccctgctgggctcacttgactgtccctgagcccatcactcacccttttggagcaatttttgaaacagaccgctaagtacccagggtattagctggtctcatccctaccatgccggggaacagcatttggatcaccgcagtagcagcccaaggagacacacaagtagctgctttctcggactgtattattttctgaaacacatccaccaggagctggacaaggagctgggggagagcgagggcctcagtgacgacgaggagaccatctccaccagggtggtccgg

SEQ ID NO: 1879 - DNA, 500 bp, Homo sapiens
gaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtg

SEQ ID NO: 1880 - DNA, 64 bp, Homo sapiens
ctgctcctcctcaagcccccaaggcccttcggcgggcccctgctgaaagaccggcatgccctat

SEQ ID NO: 1881 - DNA, 500 bp, Homo sapiens
cacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcag

SEQ ID NO: 1882 - DNA, 500 bp, Homo sapiens
gcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcaggg

SEQ ID NO: 1883 - DNA, 150 bp, Homo sapiens
gcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaac

SEQ ID NO: 1884 - DNA, 500 bp, Homo sapiens
cacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacat

SEQ ID NO: 1885 - DNA, 500 bp, Homo sapiens
tgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaac

SEQ ID NO: 1886 - DNA, 36 bp, Homo sapiens
gtcaatttcacaccacaggacgaattgacacctctc

SEQ ID NO: 1887 - DNA, 162 bp, Homo sapiens
cactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcc

SEQ ID NO: 1888 - DNA, 500 bp, Homo sapiens
ccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcc

SEQ ID NO: 1889 - DNA, 162 bp, Homo sapiens
cacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaat

SEQ ID NO: 1890 - DNA, 36 bp, Homo sapiens
ccgcacagccctgcctggagcggactcactcccctc

SEQ ID NO: 1891 - DNA, 500 bp, Homo sapiens
catctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatga

SEQ ID NO: 1892 - DNA, 500 bp, Homo sapiens
catcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatg

SEQ ID NO: 1893 - DNA, 500 bp, Homo sapiens
cacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagat

SEQ ID NO: 1894 - DNA, 500 bp, Homo sapiens
gccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgat

SEQ ID NO: 1895 - DNA, 500 bp, Homo sapiens
gctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttcc

SEQ ID NO: 1896 - DNA, 500 bp, Homo sapiens
cgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggagga

SEQ ID NO: 1897 - DNA, 500 bp, Homo sapiens
agagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctgg

SEQ ID NO: 1898 - DNA, 500 bp, Homo sapiens
ccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggag

SEQ ID NO: 1899 - DNA, 62 bp, Homo sapiens
gaggactccctcatccccagcagcccggccaccgagacctcagacaacatcagcccggtggc

SEQ ID NO: 1900 - DNA, 500 bp, Homo sapiens
ggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaaga

SEQ ID NO: 1901 - DNA, 189 bp, Homo sapiens
ggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccac

SEQ ID NO: 1902 - DNA, 500 bp, Homo sapiens
cccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccga

SEQ ID NO: 1903 - DNA, 176 bp, Homo sapiens
agctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagaga

SEQ ID NO: 1904 - DNA, 500 bp, Homo sapiens
agtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgag

SEQ ID NO: 1905 - DNA, 193 bp, Homo sapiens
tcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcc

SEQ ID NO: 1906 - DNA, 500 bp, Homo sapiens
ctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaagg

SEQ ID NO: 1907 - DNA, 500 bp, Homo sapiens
ccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgat

SEQ ID NO: 1908 - DNA, 500 bp, Homo sapiens
gtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtg

SEQ ID NO: 1909 - DNA, 500 bp, Homo sapiens
cgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctt

SEQ ID NO: 1910 - DNA, 36 bp, Homo sapiens
ctttgggggccgggcgcggtggcgcacacctgtaat

SEQ ID NO: 1911 - DNA, 36 bp, Homo sapiens
agtgtggagaggcgctcggtgagcctggggcatcct

SEQ ID NO: 1912 - DNA, 36 bp, Homo sapiens
ctgccctgccctgcccaggctccatcctgagccaca

SEQ ID NO: 1913 - DNA, 36 bp, Homo sapiens
actggcttctccgactcatcctctctgcgccccatg

SEQ ID NO: 1914 - DNA, 506 bp, Homo sapiens
tcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaa

SEQ ID NO: 1915 - DNA, 117 bp, Homo sapiens
gacagaccgcgaggtagagatcctaaacaagacgactgggatgtcacagtcaactgagctcctcccagatgccacggatgaagaggtcgcgccccccaagcctcctctgcctggcat

SEQ ID NO: 1916 - DNA, 500 bp, Homo sapiens
caacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgc

SEQ ID NO: 1917 - DNA, 141 bp, Homo sapiens
acaagcggttgacccaggccatccagaaagccagggatcatggtctcctcatttaccacatcccccaggttgaaccacgggaccttgacttcagtacctctcatggggctgtgagtgctactccgccagcccccaccctgg

SEQ ID NO: 1918 - DNA, 36 bp, Homo sapiens
gaagagagtggccccccacctgagtcaatgcccaag

SEQ ID NO: 1919 - DNA, 422 bp, Homo sapiens
gttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaggtgacccctggtacccatggtacaactggaaacagccaccg

SEQ ID NO: 1920 - DNA, 36 bp, Homo sapiens
ctcatgaagccgcccgcggtgcagattcactttata

SEQ ID NO: 1921 - DNA, 36 bp, Homo sapiens
ccaacatgcttcccaaaggtcccagcaccccacttc

SEQ ID NO: 1922 - DNA, 88 bp, Homo sapiens
agtgggacttcgcctgggagcagttccgaaatgccacactggtcaatgaggctgacaagctccgggcagccctggcctgcagcaaaga

SEQ ID NO: 1923 - DNA, 193 bp, Homo sapiens
gcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagc

SEQ ID NO: 1924 - DNA, 73 bp, Homo sapiens
gggagcagttccgaaatgccacactggtcaatgaggctgacaagctccgggcagccctggcctgcagcaaaga

SEQ ID NO: 1925 - DNA, 71 bp, Homo sapiens
ccccaactggaatgtcactgagttccacaccacgcccaagatgtccacgtacttgctggccttcattgtca

SEQ ID NO: 1926 - DNA, 500 bp, Homo sapiens
tcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcag

SEQ ID NO: 1927 - DNA, 500 bp, Homo sapiens
tcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgct

SEQ ID NO: 1928 - DNA, 107 bp, Homo sapiens
gatgcaggctgcagatgcccggaagtccttcccatgcttcgatgagccggccatgaaggccgagttcaacatcacgcttatccaccccaaggacctgacagccctgt

SEQ ID NO: 1929 - DNA, 76 bp, Homo sapiens
cagaagaccccaactggaatgtcactgagttccacaccacgcccaagatgtccacgtacttgctggccttcattgt

SEQ ID NO: 1930 - DNA, 137 bp, Homo sapiens
atccaactccccaccaccgtgcgggacatcatgaaccgctggaccctgcagatgggcttcccggtcatcacggtggataccagcacggggaccctttcccaggagcacttcctccttgaccccgattccaatgttac

SEQ ID NO: 1931 - DNA, 500 bp, Homo sapiens
catcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgagg

SEQ ID NO: 1932 - DNA, 500 bp, Homo sapiens
gcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtgg

SEQ ID NO: 1933 - DNA, 500 bp, Homo sapiens
gtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctcc

SEQ ID NO: 1934 - DNA, 500 bp, Homo sapiens
ctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagc

SEQ ID NO: 1935 - DNA, 96 bp, Homo sapiens
atgctggccaggctggtcttgaacttctgacttgaggtgatccacccacctcgtcctcctaaagtgctgggattacaggcgtgagccactgcacct

SEQ ID NO: 1936 - DNA, 500 bp, Homo sapiens
gctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagt

SEQ ID NO: 1937 - DNA, 500 bp, Homo sapiens
acaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttc

SEQ ID NO: 1938 - DNA, 129 bp, Homo sapiens
gagcttcccagctgctttgtttacctaagcaggcctgggcaatggcgggcgcccctcccccagcctcgctgccgccttgcagtttgatctcagactgctgtgctagcaatcagcgagactcggtgggcg

SEQ ID NO: 1939 - DNA, 36 bp, Homo sapiens
ggaagaaattggtaatcggtgagtaaagcagatact

SEQ ID NO: 1940 - DNA, 98 bp, Homo sapiens
tcatttgcacatctttcttggacttgggatatacagttccagtttattagcagcaactgctagggaaatgattttggtgttttgggttaattgcttct

SEQ ID NO: 1941 - DNA, 226 bp, Homo sapiens
aaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagaca

SEQ ID NO: 1942 - DNA, 224 bp, Homo sapiens
caccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgcgtcctaccctgccctccgtgcctctctgctgccgcagtcgctggcggcggcggccgccgtcccg

SEQ ID NO: 1943 - DNA, 500 bp, Homo sapiens
cctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatt

SEQ ID NO: 1944 - DNA, 500 bp, Homo sapiens
aagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaact

SEQ ID NO: 1945 - DNA, 108 bp, Homo sapiens
aagatgtggatgccttaatgaagagcttgcaggtcaaatcttcgcctgtggtaaatgatggtgtggttcgtttgagaggacttccttatagttgcaatgagaaagaca

SEQ ID NO: 1946 - DNA, 500 bp, Homo sapiens
ttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccact

SEQ ID NO: 1947 - DNA, 95 bp, Homo sapiens
ttccgcagcttggcctacatccactcccagggcgtgtgtcaccgcgacatcaagccccagaacctgctggtggaccctgacactgctgtcctcaa

SEQ ID NO: 1948 - DNA, 500 bp, Homo sapiens
cgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatag

SEQ ID NO: 1949 - DNA, 36 bp, Homo sapiens
gatgggcaggtggaagaagagcccctcaatagtgaa

SEQ ID NO: 1950 - DNA, 500 bp, Homo sapiens
atgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagac

SEQ ID NO: 1951 - DNA, 169 bp, Homo sapiens
atgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttctta

SEQ ID NO: 1952 - DNA, 373 bp, Homo sapiens
gctttgcaagttcttcaccgcaaagaactgccgcagacttccgcctgggtgccaaccacgtgatcacgcgagcgttggagaggccctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttctta

SEQ ID NO: 1953 - DNA, 438 bp, Homo sapiens
gctttgcaagttcttcaccgcaaagaactgccgcagacttccgcctgggtgccaaccacgtgatcacgcgagcgttggagaggccctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcat

SEQ ID NO: 1954 - DNA, 500 bp, Homo sapiens
tcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaa

SEQ ID NO: 1955 - DNA, 500 bp, Homo sapiens
atggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaa

SEQ ID NO: 1956 - DNA, 36 bp, Homo sapiens
aatgtggcttggttgtaggtgaccgggttattgatg

SEQ ID NO: 1957 - DNA, 36 bp, Homo sapiens
agttgtagcttccacctgcaccttctagccaccatg

SEQ ID NO: 1958 - DNA, 36 bp, Homo sapiens
atttctgctgcatttctggctgatgtccggccccaa

SEQ ID NO: 1959 - DNA, 500 bp, Homo sapiens
tgttttgtttcagctttataaagaccttgttgtgagtcaagtgatcagtgctgaggaattctgggccaatcgtttaaatgtgaatgcaacagatagttcttccacatccaatcataagcaggatgttggcatttctgctgcatttctggctgatgtccggccccaaactgatggctgtaacggtctaagatataatttaacttctgatatcattgagtccatatttaggacctatccagcagtaaaaatgaaatatgcagaaaatgttccccacaacatgacagagaaggaattctggacacgttttttccagtcccattattttcacagggatcggctgaatacagggtcaaaggatctctttgcagaatgtgccaaaatagatgaaaaaggcctaaaaacaatggtttcattaggagtgaaaaacccactactagatttaacagctttggaagataaaccattagatgagggctatggcatttcctctgtgccatctg

SEQ ID NO: 1960 - DNA, 500 bp, Homo sapiens
gccagtagtaccatcacagcactgtcacctggaggggcacttatgcagggaggaacacagcaagccataaaccagatggtgccaaatgatattcaatctgaattgaaacacttatatgtagctgttggagaacttctacgacatttctggtcctgctttcctgttaatacgccattcctagaagaaaaggtagtgaaaatgaaaagtaatttggaacgattccaagttacgaagctctgtccattccaagaaaagattcggagacagtatttaagcacaaatttggtaagtcacatagaagagatgctccagacagcctacaacaagctccacacatggcagtcacggcgtctgatgaagaaaacgtgaggtggccatgatgcttacaggttttgtgagattgagagaactatgacctgcagcaactctggaaacctggcctgacagacaagcagatgacctcacaggagtgataagaaacatctgctccacgccaactc

SEQ ID NO: 1961 - DNA, 36 bp, Homo sapiens
gttctgtgtgtttgtcaatattctgcaatttcagcc

SEQ ID NO: 1962 - DNA, 36 bp, Homo sapiens
tcagctctcgagtccatgtgtaaagaactggccaag

SEQ ID NO: 1963 - DNA, 36 bp, Homo sapiens
actatctccaggtggaaggtaaaacctaatttcatt

SEQ ID NO: 1964 - DNA, 36 bp, Homo sapiens
aggagaaaagccgtttgtttgtgcagccaatggctg

SEQ ID NO: 1965 - DNA, 36 bp, Homo sapiens
ccagcctggcaaaagatggctccaccgaggacaccg

SEQ ID NO: 1966 - DNA, 36 bp, Homo sapiens
tgtctggctccattttaggctcacggaatttgaaga

SEQ ID NO: 1967 - DNA, 91 bp, Homo sapiens
cacccccaccagtcagttgaccattgatgagttcatgaagatcgacctggaggaggagtgcgaccccccctcgtacacagctgggcagagg

SEQ ID NO: 1968 - DNA, 36 bp, Homo sapiens
cagtggtccgatgactttgacagcgactatgaaaat

SEQ ID NO: 1969 - DNA, 36 bp, Homo sapiens
cacctccacctgaaaaagctcccatggtgaatagat

SEQ ID NO: 1970 - DNA, 500 bp, Homo sapiens
tggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagtt

SEQ ID NO: 1971 - DNA, 26 bp, Homo sapiens
agcacctccaagtgttcctcgaaggg

SEQ ID NO: 1972 - DNA, 357 bp, Homo sapiens
acttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggag

SEQ ID NO: 1973 - DNA, 500 bp, Homo sapiens
tgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaacca

SEQ ID NO: 1974 - DNA, 36 bp, Homo sapiens
ggaacaagccattagcagagttcttgaagccagcat

SEQ ID NO: 1975 - DNA, 88 bp, Homo sapiens
gttcctcatctgtgcttatcagaataacaaagaactcttgtctaaaggcttatacagaggacatgatgaagaattgatatcacattat

SEQ ID NO: 1976 - DNA, 36 bp, Homo sapiens
cctacctcagcctcccagagtgccatgctgccagct

SEQ ID NO: 1977 - DNA, 132 bp, Homo sapiens
atggcggccgcgacgttgacttcgaaattgtactccctgctgttccgcaggacctccaccttcgccctcaccatcatcgtgggcgtcatgttcttcgagcgcgccttcgatcaaggcgcggacgctatctac

SEQ ID NO: 1978 - DNA, 76 bp, Homo sapiens
gagacaagattttgccttatttcccaggctggtctcgaactcctgggctcaagccattcgtctgcctcagcctccc

SEQ ID NO: 1979 - DNA, 500 bp, Homo sapiens
aaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatg

SEQ ID NO: 1980 - DNA, 197 bp, Homo sapiens
cttatttgaggttgaacttttgtgaaattgtgttcaacaggagaacattagggcgtggctatgagtgccaggtctgctcctagcaacaccaaagcctagctggtagtaccacatgagctcccagaagctagggtgctctttctcaaacaaaaaaatcagatgtgccagtgaaacgttgttggtctgcaatttgtttt

SEQ ID NO: 1981 - DNA, 36 bp, Homo sapiens
aagctctgtcttctgcaggcatcctgtcggctcaca

SEQ ID NO: 1982 - DNA, 451 bp, Homo sapiens
cctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagt

SEQ ID NO: 1983 - DNA, 500 bp, Homo sapiens
ggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatc

SEQ ID NO: 1984 - DNA, 36 bp, Homo sapiens
ggtgcccgtcagcagcaggtcaccacctatttgcac

SEQ ID NO: 1985 - DNA, 320 bp, Homo sapiens
ctgtcgcctaggctggagtgcagtggcgcgatctcggctcactgcaagctctgcctcccgggttcacgcctcagcctccctagtagctgggattacaggcacgtgccaccatgcctggctaattttttgtatttttagtagagacagggttttaccatgttagccaggatggtctccatctcctgacttcgtgatccgcctgcctcggcctcccaaagtgctgggattacaggtgtgagccaccgtacccggccagaagaaaactcttactacaaacctttccatattatgagaaaacatcttgtccttttaaaataaat

SEQ ID NO: 1986 - DNA, 36 bp, Homo sapiens
gagccccgcccaccccaggccgttcctccccagctg

SEQ ID NO: 1987 - DNA, 36 bp, Homo sapiens
aagcaggatgtgcagaaggtgctggcgggcagggat

SEQ ID NO: 1988 - DNA, 36 bp, Homo sapiens
agaaggtaaactccgcaagctcagaatcattcatgc

SEQ ID NO: 1989 - DNA, 36 bp, Homo sapiens
ccagagatggaccgcaggaatgcagtggtgtctttt

SEQ ID NO: 1990 - DNA, 500 bp, Homo sapiens
gattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatc

SEQ ID NO: 1991 - DNA, 375 bp, Homo sapiens
tcagacccaaaagcagatggacagaaagcaactgaaaaagcccaggaaaaaagaatacaccagccattacctcttgcgtttgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgg

SEQ ID NO: 1992 - DNA, 500 bp, Homo sapiens
tcagacccaaaagcagatggacagaaagcaactgaaaaagcccaggaaaaaagaatacaccagccattacctcttgcgtttgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaaca

SEQ ID NO: 1993 - DNA, 500 bp, Homo sapiens
gaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaggaagaccaaaaaggaaaaaagactga

SEQ ID NO: 1994 - DNA, 500 bp, Homo sapiens
ctggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggc

SEQ ID NO: 1995 - DNA, 301 bp, Homo sapiens
gagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctga

SEQ ID NO: 1996 - DNA, 64 bp, Homo sapiens
caaaactggatttacagaagccctccgttcctgccataccgccaaaaaagcctcggccacctaa

SEQ ID NO: 1997 - DNA, 36 bp, Homo sapiens
cttcgtgctgccatgaagggccttggaactgatgaa

SEQ ID NO: 1998 - DNA, 36 bp, Homo sapiens
cttcgtgctgccatgaaggtaaatcgcccaatttga

SEQ ID NO: 1999 - DNA, 36 bp, Homo sapiens
aggttggtgagggagatcgcgcaggatttcaaaacc

SEQ ID NO: 2000 - DNA, 36 bp, Homo sapiens
tccacatcttcaagtctggaatgttccggagaatca

SEQ ID NO: 2001 - DNA, 495 bp, Homo sapiens
tgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcaga

SEQ ID NO: 2002 - DNA, 123 bp, Homo sapiens
acatcttgaactacatcgatcatggagacccacaggttcgaggagccactgccattctctgtgggaccctcatctgctccatcctcagcaggtcccgcttccacgtgggagattggatgggca

SEQ ID NO: 2003 - DNA, 172 bp, Homo sapiens
cagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcaga

SEQ ID NO: 2004 - DNA, 36 bp, Homo sapiens
ccacactggccggcccgggtgagcagcgcggcccgc

SEQ ID NO: 2005 - DNA, 36 bp, Homo sapiens
catcagagatcatgagagcctgtagccaccaatgtt

SEQ ID NO: 2006 - DNA, 289 bp, Homo sapiens
gcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagg

SEQ ID NO: 2007 - DNA, 237 bp, Homo sapiens
ccaggatggtgtttagtggcatgatctcggctcactgcaacatacccctcctgggttcaagtgattcttctgcctcagcctcccaagtagctgggattacaggtgtgcaccaccacacctggctaatttttgtatttttagtagagatgggctttcgccatgttggccaggctggtctcaaactcctgacctcaagtgatccacctacctcagcctcccaaagtgctgggattacag

SEQ ID NO: 2008 - DNA, 36 bp, Homo sapiens
ggggccatccactttgaggactttgtggttggcctc

SEQ ID NO: 2009 - DNA, 500 bp, Homo sapiens
gtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctc

SEQ ID NO: 2010 - DNA, 500 bp, Homo sapiens
gcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggat

SEQ ID NO: 2011 - DNA, 500 bp, Homo sapiens
tcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcac

SEQ ID NO: 2012 - DNA, 160 bp, Homo sapiens
acccaggctggagagcagtggcatgatctcggctcactgcaacctctgcctcccaggttaaagtgattcttgtgcctcagctttccgagtagctgggactccaggcaggtgccaccacacctggctaatttttgtatttttagtagagatgggttctcac

SEQ ID NO: 2013 - DNA, 36 bp, Homo sapiens
gtatttgctgttttaaaggacacagatttagacttg

SEQ ID NO: 2014 - DNA, 36 bp, Homo sapiens
atttcatgctttcattaggccttgtgaaaaagggta

SEQ ID NO: 2015 - DNA, 36 bp, Homo sapiens
tagattttggcagcaacggtgagtagttatttttgt

SEQ ID NO: 2016 - DNA, 36 bp, Homo sapiens
agaagcctggctacaatactgcacaaacttggttag

SEQ ID NO: 2017 - DNA, 36 bp, Homo sapiens
cctacttaccctagtcagcctgccacagtgactcag

SEQ ID NO: 2018 - DNA, 36 bp, Homo sapiens
cccggcccggccgcggagagccccgcttcatctcag

SEQ ID NO: 2019 - DNA, 36 bp, Homo sapiens
cccggcccggccgcggagtattgggaccgggagaca

SEQ ID NO: 2020 - DNA, 25 bp, Homo sapiens
gtgtttcccaaggagcctgtggagc

SEQ ID NO: 2021 - DNA, 500 bp, Homo sapiens
tgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatc

SEQ ID NO: 2022 - DNA, 61 bp, Homo sapiens
tgggcagagtgcggcagctcatgcctgtaatcccagcacttagggaggccgaggagggcag

SEQ ID NO: 2023 - DNA, 501 bp, Homo sapiens
tgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaa

SEQ ID NO: 2024 - DNA, 75 bp, Homo sapiens
ggttgcagtgagccaggattgtgcgactgcactccagcctgggtgacagggtgaaacgccatctcaaaaaataaa

SEQ ID NO: 2025 - DNA, 36 bp, Homo sapiens
ggaggaagaagagctcagatagaaacagagggagct

SEQ ID NO: 2026 - DNA, 500 bp, Homo sapiens
ttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggca

SEQ ID NO: 2027 - DNA, 500 bp, Homo sapiens
aatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacgg

SEQ ID NO: 2028 - DNA, 36 bp, Homo sapiens
gtatttgctgcagaacagtgtgaagcagtattctgg

SEQ ID NO: 2029 - DNA, 36 bp, Homo sapiens
cgccaatgaccaatgcagtacaatgccagtgtttca

SEQ ID NO: 2030 - DNA, 36 bp, Homo sapiens
cagcagtggccccgagcggtatgtcccaacagttta

SEQ ID NO: 2031 - DNA, 36 bp, Homo sapiens
caatgatgtttgatgaccgtcgcggacgcccagtgg

SEQ ID NO: 2032 - DNA, 500 bp, Homo sapiens
tgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacac

SEQ ID NO: 2033 - DNA, 447 bp, Homo sapiens
taaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgag

SEQ ID NO: 2034 - DNA, 500 bp, Homo sapiens
gtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttcttacaaacagggttgggggggggaagggcgtgcaaaaactaacattgaaattttgaaacagcagcagagtgagtggattttatttttcg

SEQ ID NO: 2035 - DNA, 36 bp, Homo sapiens
gaggagaacttctttgagatctgcgatgagctggga

SEQ ID NO: 2036 - DNA, 36 bp, Homo sapiens
ttcaggcgatggtggaatttgactcagttcaaagtg

SEQ ID NO: 2037 - DNA, 500 bp, Homo sapiens
taaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaaca

SEQ ID NO: 2038 - DNA, 26 bp, Homo sapiens
gagtgaagcggccatcttctgtgaaa

SEQ ID NO: 2039 - DNA, 500 bp, Homo sapiens
cattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagag

SEQ ID NO: 2040 - DNA, 500 bp, Homo sapiens
aaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattg

SEQ ID NO: 2041 - DNA, 36 bp, Homo sapiens
ggaagtccactctgcccgacgtggtctcccatccct

SEQ ID NO: 2042 - DNA, 36 bp, Homo sapiens
tacatccagccccagggcgtcccgccggccgagagc

SEQ ID NO: 2043 - DNA, 36 bp, Homo sapiens
tattctgtttcttactaggaatcaaccctcaaaagc

SEQ ID NO: 2044 - DNA, 166 bp, Homo sapiens
gtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttaga

SEQ ID NO: 2045 - DNA, 36 bp, Homo sapiens
ctctgcctcctccctgaccacccatgccctttcctt

SEQ ID NO: 2046 - DNA, 500 bp, Homo sapiens
taacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctg

SEQ ID NO: 2047 - DNA, 295 bp, Homo sapiens
agctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaag

SEQ ID NO: 2048 - DNA, 500 bp, Homo sapiens
agagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttcccccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgc

SEQ ID NO: 2049 - DNA, 36 bp, Homo sapiens
tttccccggagccggcgcgggagtgagccataactg

SEQ ID NO: 2050 - DNA, 440 bp, Homo sapiens
gggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgaactttttctgcaaatcaaggaaagcttcccggaggaagtggtgcctaagctgtgctctgattcacgtttagaag

SEQ ID NO: 2051 - DNA, 162 bp, Homo sapiens
ccctcccccagcctcgctgctgccttgcagtttgatctcagactgctgtgctagcaatcagcgagactccgtgggcgtaggaccctccgagccaggtgtgggatataatctcttggttcgccgttttttaagccagtctgaaaagcgcaatattcgggtggg

SEQ ID NO: 2052 - DNA, 500 bp, Homo sapiens
tgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaa

SEQ ID NO: 2053 - DNA, 217 bp, Homo sapiens
tttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaat

SEQ ID NO: 2054 - DNA, 303 bp, Homo sapiens
ttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgtt

SEQ ID NO: 2055 - DNA, 500 bp, Homo sapiens
gttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaa

SEQ ID NO: 2056 - DNA, 469 bp, Homo sapiens
gtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctct

SEQ ID NO: 2057 - DNA, 64 bp, Homo sapiens
aatgcttttgttgtgatggtggcttgaggtgttgggaatctggagatgatccatgggtagaaca

SEQ ID NO: 2058 - DNA, 135 bp, Homo sapiens
tagtgttccagttcagcctgagcagcttgcaagtgctggtttttattatgtgggtcgcaatgatgatgtcaaatgcttttgttgtgatggtggcttgaggtgttgggaatctggagatgatccatgggtagaaca

SEQ ID NO: 2059 - DNA, 500 bp, Homo sapiens
cctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaaca

SEQ ID NO: 2060 - DNA, 500 bp, Homo sapiens
aaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcc

SEQ ID NO: 2061 - DNA, 373 bp, Homo sapiens
tacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaa

SEQ ID NO: 2062 - DNA, 36 bp, Homo sapiens
ccaccaacacagtttttggtgagttcctaattttaa

SEQ ID NO: 2063 - DNA, 36 bp, Homo sapiens
aggcgggcggatcacgaggtcaggagatcgagacca

SEQ ID NO: 2064 - DNA, 36 bp, Homo sapiens
gcaggatggggtgctccgccctgccctcggtgctca

SEQ ID NO: 2065 - DNA, 36 bp, Homo sapiens
cagtctgacccgccacggcctcatcgcattctccag

SEQ ID NO: 2066 - DNA, 36 bp, Homo sapiens
accacccaatgaaaaaaggttggtttgtccaagatg

SEQ ID NO: 2067 - DNA, 36 bp, Homo sapiens
aaagtggatgaaaacatggtcattgacgagactctg

SEQ ID NO: 2068 - DNA, 36 bp, Homo sapiens
ggcctcgaggaagagcgggaatccgtgggcccactg

SEQ ID NO: 2069 - DNA, 36 bp, Homo sapiens
agccacgggatcgtggaggttgatccaatgctcacc

SEQ ID NO: 2070 - DNA, 36 bp, Homo sapiens
cacacggtagtcaaagaggcatgtctgactcaggga

SEQ ID NO: 2071 - DNA, 108 bp, Homo sapiens
gtgttagccaggatggtctcggtctcctgacctcgtgatccgcccacctcggcctcccaaagtgctgagattataggcgtgagccatcgcgcccagcccgtgtgttta

SEQ ID NO: 2072 - DNA, 26 bp, Homo sapiens
cagccggagttgtaccacccaatgaa

SEQ ID NO: 2073 - DNA, 31 bp, Homo sapiens
aggatgggggactgatcggtgccgaagagaa

SEQ ID NO: 2074 - DNA, 236 bp, Homo sapiens
gtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgtt

SEQ ID NO: 2075 - DNA, 99 bp, Homo sapiens
aggatggtctcggtctcctgacctcgtgatccgcccacctcggcctcccaaagtgctgagattataggcgtgagccatcgcgcccagcccgtgtgttta

SEQ ID NO: 2076 - DNA, 500 bp, Homo sapiens
atggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacaga

SEQ ID NO: 2077 - DNA, 93 bp, Homo sapiens
tctggactttctccaaaggcactgaccctcggcctctactttgtcccctcacctccaccccctcctgtcaccggccttgtgacattcactcag

SEQ ID NO: 2078 - DNA, 119 bp, Homo sapiens
aggatgggggactgatcggtgccgaagagaaagtgattaacagtaagaataaagtggatgaaaacatggtcattgacgagactctggatgttaaggaaatgattttcaatgccgagaga

SEQ ID NO: 2079 - DNA, 471 bp, Homo sapiens
gtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatata

SEQ ID NO: 2080 - DNA, 500 bp, Homo sapiens
accacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattcc

SEQ ID NO: 2081 - DNA, 50 bp, Homo sapiens
aggatgggggactgatcggtgccgaagagaaagtgattaacagtaagaat

SEQ ID NO: 2082 - DNA, 39 bp, Homo sapiens
gatgttaaggaaatgattttcaatgccgagagagttgga

SEQ ID NO: 2083 - DNA, 500 bp, Homo sapiens
cgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagtt

SEQ ID NO: 2084 - DNA, 120 bp, Homo sapiens
cgggaggacttcagtctgagtagcagtgctctcattggcctgctggtcatcgcagtggccattgccacggtcatcgtcatcagcctggtgatgctgaggaagaggcagtatggcaccatc

SEQ ID NO: 2085 - DNA, 36 bp, Homo sapiens
taccgccagaaggtggagccgctgcgcgcagagctc

SEQ ID NO: 2086 - DNA, 36 bp, Homo sapiens
ccctggtggctgtcgccgtgccctcttccaggacaa

SEQ ID NO: 2087 - DNA, 36 bp, Homo sapiens
agaaatacacacctacatgtgagttcagaaactgaa

SEQ ID NO: 2088 - DNA, 500 bp, Homo sapiens
gcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcagga

SEQ ID NO: 2089 - DNA, 36 bp, Homo sapiens
atcccagctactaaagaggctgaggcaggagaatgg

SEQ ID NO: 2090 - DNA, 450 bp, Homo sapiens
gagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaa

SEQ ID NO: 2091 - DNA, 36 bp, Homo sapiens
acctctgcccttccgcagccatcgagttgatcaaag

SEQ ID NO: 2092 - DNA, 112 bp, Homo sapiens
catgagcatcgccgaggagctgctgtacctgcgcgtggtgcgtggcctaatggccgccatgggcaacacggaccacagcaacagccagcggctggccagcctcacgctggag

SEQ ID NO: 2093 - DNA, 500 bp, Homo sapiens
aggctggagtgcaggggtgtgatctcagttcgctgcaacctctgcctcccaggttcaagtgattcttctgcctcatcctcctgagtcgctgggattacaggtgtgaggtatcatgcctggcccaagatttactttatttgatattaatatagccacatctgcttacttttaaaattaatgtctgcatggcatattattgctattccttaatttccaatttacctctatcattatagcttacccactgatgtagctttagcagctgctgtcccagttctcaaatatccaggctagcttggtggcccctttatccatgggtcatttatttaatccaatctgccaatccctgcctttaattagtgtttttaaaccatttacatttaatgtaattattcatagtttaatctgatgtctgttattttattttttgtcttctccttattttctgtttcttttttgctcttgtctttcttgtcttgttttttctcttccctttaaca

SEQ ID NO: 2094 - DNA, 36 bp, Homo sapiens
tgctgcagcgcggaggaggattccaaggtgttggaa

SEQ ID NO: 2095 - DNA, 36 bp, Homo sapiens
gatatctacgcctcacagagtatgacattgcagctg

SEQ ID NO: 2096 - DNA, 87 bp, Homo sapiens
tgcagaggcatgatcttggctcatggcaacctccacctcctgggttcaagcaattctcctgcctcagcctcctgagtagctgggact

SEQ ID NO: 2097 - DNA, 254 bp, Homo sapiens
cacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccat

SEQ ID NO: 2098 - DNA, 36 bp, Homo sapiens
acaggaccacctgcccaggcccctgtgactcgcagc

SEQ ID NO: 2099 - DNA, 36 bp, Homo sapiens
taatgatttccctgctgtcctccgtccgctaagtat

SEQ ID NO: 2100 - DNA, 363 bp, Homo sapiens
tggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattg

SEQ ID NO: 2101 - DNA, 170 bp, Homo sapiens
ttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaat

SEQ ID NO: 2102 - DNA, 500 bp, Homo sapiens
agtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtcca

SEQ ID NO: 2103 - DNA, 500 bp, Homo sapiens
cccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccac

SEQ ID NO: 2104 - DNA, 500 bp, Homo sapiens
tactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagta

SEQ ID NO: 2105 - DNA, 500 bp, Homo sapiens
atggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgat

SEQ ID NO: 2106 - DNA, 36 bp, Homo sapiens
cttgaacccgggaggcagaggttgcagtgagccaag

SEQ ID NO: 2107 - DNA, 61 bp, Homo sapiens
caattctcctgcctcagcccccctagtagctgggactacaggcgcacaccaccacgctcag

SEQ ID NO: 2108 - DNA, 36 bp, Homo sapiens
ttaaaaatgaaattacaggtgtgagccaccgtgcac

SEQ ID NO: 2109 - DNA, 62 bp, Homo sapiens
gatctcatctcagtgcaacctccacctctcacgttcaagcggttctcatgtctcagcctccc

SEQ ID NO: 2110 - DNA, 36 bp, Homo sapiens
gccctcggtcctccccagcaagcgagcctgacgctg

SEQ ID NO: 2111 - DNA, 36 bp, Homo sapiens
cttgggaggctgaggcaggagaatggcgtgaacctg

SEQ ID NO: 2112 - DNA, 36 bp, Homo sapiens
cttgggaggctgaggcaggagaatcgcttgaacccg

SEQ ID NO: 2113 - DNA, 36 bp, Homo sapiens; identical to SEQ ID NO: 1155

SEQ ID NO: 2114 - DNA, 36 bp, Homo sapiens; identical to SEQ ID NO: 1157

SEQ ID NO: 2115 - DNA, 36 bp, Homo sapiens; identical to SEQ ID NO: 1159

SEQ ID NO: 2116 - DNA, 36 bp, Homo sapiens
ctcctcttccaccctcagtggatgataatctgaagg

SEQ ID NO: 2117 - DNA, 96 bp, Homo sapiens
ttccaccctcagcggatgataatctcaagacaccttccgagcgtcagctcactccccttccaccctcagctccaccctcagcagatgataatatca

SEQ ID NO: 2118 - DNA, 167 bp, Homo sapiens
caagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccct

SEQ ID NO: 2119 - DNA, 253 bp, Homo sapiens
ctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacc

SEQ ID NO: 2120 - DNA, 36 bp, Homo sapiens
cagctccaccctcagcagatgataatatcaagacac

SEQ ID NO: 2121 - DNA, 437 bp, Homo sapiens
tctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacc

SEQ ID NO: 2122 - DNA, 53 bp, Homo sapiens
ggatgataatctcaagacaccttccgagcgtcagctcactccccttccaccct

SEQ ID NO: 2123 - DNA, 77 bp, Homo sapiens
ggatgataatctcaagacaccttccgagcgtcagctcactccccttccaccctcagctccaccctcagcagatgata

SEQ ID NO: 2124 - DNA, 239 bp, Homo sapiens
caagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacc

SEQ ID NO: 2125 - DNA, 84 bp, Homo sapiens
ttccaccctcagcggatgataatctcaagacaccttccgagcgtcagctcactccccttccaccctcagctccaccctcagcag

SEQ ID NO: 2126 - DNA, 36 bp, Homo sapiens
atgataatctcaagacacctcctgagtgtctgctca

SEQ ID NO: 2127 - DNA, 36 bp, Homo sapiens
atgataatctcaagacacctcccgagtgtctactca

SEQ ID NO: 2128 - DNA, 500 bp, Homo sapiens
ctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcgg

SEQ ID NO: 2129 - DNA, 78 bp, Homo sapiens
ctccccttccaccctcagcggatgataatctcaagacacctcccgagtgtgtgctcactccccttccaccctcagcgg

SEQ ID NO: 2130 - DNA, 36 bp, Homo sapiens
ccctgagcctcaagacacctcccgagtgtctgctca

SEQ ID NO: 2131 - DNA, 115 bp, Homo sapiens
catcgtcattcttcaggattgccctactggccctacctcacagctgaaactttaaaaaacaggatgggccaccagccacctcctccaactcaacaacattctataactgataact

SEQ ID NO: 2132 - DNA, 36 bp, Homo sapiens
ccctgagcctcaagacacctcccgagtgtgtgctca

SEQ ID NO: 2133 - DNA, 250 bp, Homo sapiens
ctccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactcccctt

SEQ ID NO: 2134 - DNA, 500 bp, Homo sapiens
aacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgccca

SEQ ID NO: 2135 - DNA, 36 bp, Homo sapiens
ttgtcctgaccccacagtttcctgtcccatgaccag

SEQ ID NO: 2136 - DNA, 271 bp, Homo sapiens
ctttatgctgtgatagtttgtttatttatttatttatttatttatttatttgagacagagtttcgctcttgttgcccaggctggagtgcagtggcacgatctcagctcaccacaacctccgcctcccaggttcaagcgattctcctgcctcagcctcccgagtagctgggattacaggcgggagtgcagtggcatgatctcggctcactacaacctccgcatcctgggttcaagcagttctcctgtctcagcctcccgagtagctgagatt

SEQ ID NO: 2137 - DNA, 140 bp, Homo sapiens
cccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaag

SEQ ID NO: 2138 - DNA, 36 bp, Homo sapiens
cctccgatggatccactgcctctgtgcctgcctgta

SEQ ID NO: 2139 - DNA, 140 bp, Homo sapiens
gttggcactcatcatgagcccctgttctcattctgcaaatggtgaagctctctattgtcctgaccccacagttcctgtcccatgaccagggccagctcaccaaggagctgcagcagcatgtaaagtcagtgacatgccca

SEQ ID NO: 2140 - DNA, 500 bp, Homo sapiens
tgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtg

SEQ ID NO: 2141 - DNA, 500 bp, Homo sapiens
gcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagc

SEQ ID NO: 2142 - DNA, 500 bp, Homo sapiens
aaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgcctt

SEQ ID NO: 2143 - DNA, 500 bp, Homo sapiens
gagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgatctcaagacaccttccgag

SEQ ID NO: 2144 - DNA, 232 bp, Homo sapiens
gagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcgg

SEQ ID NO: 2145 - DNA, 36 bp, Homo sapiens; identical to SEQ ID NO: 2127

SEQ ID NO: 2146 - DNA, 500 bp, Homo sapiens
cgagtgtctgctccatccccttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggcc

SEQ ID NO: 2147 - DNA, 500 bp, Homo sapiens
ctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcaga

SEQ ID NO: 2148 - DNA, 166 bp, Homo sapiens
aggccagagtgcagtggtgcgatcacagctcactacaacctccgcctccccagttcaagagattctcctgcgtcagcctcctgagtagctgggattacaggcgcctgccaccacacctggctaatttttgtatttttagtactccggacgtcaggacagctgctgc

SEQ ID NO: 2149 - DNA, 36 bp, Homo sapiens
cacttgtatgcaagccaggtaaaaattttaaaaaag

SEQ ID NO: 2150 - DNA, 36 bp, Homo sapiens
ctgccaggtggcaaaaagtgatgagaagacttggaa

SEQ ID NO: 2151 - DNA, 36 bp, Homo sapiens
aagagaggtgtgagcatgggaacgcctaagctgtta

SEQ ID NO: 2152 - DNA, 500 bp, Homo sapiens
caccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaaga

SEQ ID NO: 2153 - DNA, 500 bp, Homo sapiens
ggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttg

SEQ ID NO: 2154 - DNA, 500 bp, Homo sapiens
tcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggat

SEQ ID NO: 2155 - DNA, 500 bp, Homo sapiens
acgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgg

SEQ ID NO: 2156 - DNA, 500 bp, Homo sapiens
gatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctccctt

SEQ ID NO: 2157 - DNA, 36 bp, Homo sapiens
cgggccgccggtggcgcgggctggcgcgagctcggc

SEQ ID NO: 2158 - DNA, 36 bp, Homo sapiens
gctacttgggaggctgaggcaggagaattgctcaaa

SEQ ID NO: 2159 - DNA, 409 bp, Homo sapiens
gcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggc

SEQ ID NO: 2160 - DNA, 36 bp, Homo sapiens
aacagcctccacaggcacagctccatcgttacaatg

SEQ ID NO: 2161 - DNA, 36 bp, Homo sapiens
agtgcccaccgtgcccaggtaagccagcccaggcct

SEQ ID NO: 2162 - DNA, 36 bp, Homo sapiens
tggtcatgaggcgcaagggtaggaggcagggccgct

SEQ ID NO: 2163 - DNA, 349 bp, Homo sapiens
caggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccacctagaacctgtatggccagaaggcagggccgaggggtgtgggcgggaggcccggcctggcttagtggggac

SEQ ID NO: 2164 - DNA, 36 bp, Homo sapiens
ttcatcatttcctcccagtatttgttcccgtgaatg

SEQ ID NO: 2165 - DNA, 36 bp, Homo sapiens
caggctgttcctcctcggcctcgtcacgtgttcaat

SEQ ID NO: 2166 - DNA, 134 bp, Homo sapiens
gatgaatctcctccgaaacaacagctgcctctccaaaatgaagaattccatggcttccatgtctcagcagctcaaggccaagttggatttcttcaaaaccagcatccagattgacctggagaagtacagcgagc

SEQ ID NO: 2167 - DNA, 104 bp, Homo sapiens
agaacctaacacttcacaaactgagtgaatcccagctagaactgaactggaacaacagattcttgaaccactgtttggagcacttggtgcagtaccggactgac

SEQ ID NO: 2168 - DNA, 36 bp, Homo sapiens
tgaactccttctccacaagcgccttcggtccagttg

SEQ ID NO: 2169 - DNA, 36 bp, Homo sapiens
gggacagtccacgccgagacaagcagatgcccagtg

SEQ ID NO: 2170 - DNA, 465 bp, Homo sapiens
caacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacct

SEQ ID NO: 2171 - DNA, 237 bp, Homo sapiens
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgag

SEQ ID NO: 2172 - DNA, 500 bp, Homo sapiens
caacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctcc

SEQ ID NO: 2173 - DNA, 500 bp, Homo sapiens
gcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctgg

SEQ ID NO: 2174 - DNA, 136 bp, Homo sapiens
gcctgcggccgtgtccctggccaccaattctacctactacagcacgtcggcccccaaggcggagctgctgatcaagatgaaggacctgcaggagcagcaggagcacgaagaggattcgggaagcgacttggaccac

SEQ ID NO: 2175 - DNA, 36 bp, Homo sapiens
gtgtccacccccatgcaggtgagctcctgttcttgt

SEQ ID NO: 2176 - DNA, 129 bp, Homo sapiens
aacatcacagtcactgccgtggccagaaacccccgctggctcagtgtcacctggcaagacccccactcctggaactcatctttctacagactacggtttgagctcagatatcgggctgaacggtcaaag

SEQ ID NO: 2177 - DNA, 143 bp, Homo sapiens
gggctgagcagggtcctggtggccgtggctacagccctggtgtctgcctcctccccctgcccccaggcctggggccccccaggggtccagtatgggcagccaggcaggtccgtgaagctgtgttgtcctggagtgactgccgg

SEQ ID NO: 2178 - DNA, 36 bp, Homo sapiens
ggggcgccgcgcctacggaaactcagccacctgtga

SEQ ID NO: 2179 - DNA, 36 bp, Homo sapiens
tcaattttctaaccttagaaaatagctccggaaact

SEQ ID NO: 2180 - DNA, 36 bp, Homo sapiens
tgcctttaacttcccgtggtaagttttagaagtcct

SEQ ID NO: 2181 - DNA, 36 bp, Homo sapiens
gccaagaaatgagtataggctcaagattattatatt

SEQ ID NO: 2182 - DNA, 36 bp, Homo sapiens
tgattctcatgcctcatcctcccaaagtgctgggat

SEQ ID NO: 2183 - DNA, 500 bp, Homo sapiens
atatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgttt

SEQ ID NO: 2184 - DNA, 500 bp, Homo sapiens
catgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttgga

SEQ ID NO: 2185 - DNA, 60 bp, Homo sapiens
atgttgcccaggctgatcttgaactcctgacctcaagtgatctgcccacctcagcctccc

SEQ ID NO: 2186 - DNA, 36 bp, Homo sapiens
gaaggggacgccgacaagagttgaagtattgataac

SEQ ID NO: 2187 - DNA, 500 bp, Homo sapiens
aggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcacctgaccatatttttaaaatatagagtcgataatgagttatactgggtttttttttttctgtttttttttttctgagatggagtttcactcttgttgcccaggctggagtgcaatggggcgatctcggctcactgcaacctccgcctccctggttcaagtgattttcctcctaagcctcccaagtagctgggattacaggcgcatgccaccatgcccagctaatttttgtatttttagtggagacag

SEQ ID NO: 2188 - DNA, 114 bp, Homo sapiens
ttcggttagaggccacagaaacgcagctgcccatctacacgcctctcacccaccatggggagttgacaggccacttccagggggagatcaagctgcagacctctcagggcaaga

SEQ ID NO: 2189 - DNA, 36 bp, Homo sapiens
tgtttgttggctgtgcaggtcttttggctaaaaagg

SEQ ID NO: 2190 - DNA, 36 bp, Homo sapiens
ttctttttggaatgacagtgcaatacagaatgcacc

SEQ ID NO: 2191 - DNA, 36 bp, Homo sapiens
tttgcaaccagtgcctgagtatgagattgtttttct

SEQ ID NO: 2192 - DNA, 321 bp, Homo sapiens
ggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttca

SEQ ID NO: 2193 - DNA, 288 bp, Homo sapiens
aagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgtt

SEQ ID NO: 2194 - DNA, 500 bp, Homo sapiens
tcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagca

SEQ ID NO: 2195 - DNA, 361 bp, Homo sapiens
aactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagag

SEQ ID NO: 2196 - DNA, 183 bp, Homo sapiens
aaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttca

SEQ ID NO: 2197 - DNA, 500 bp, Homo sapiens
cagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgc

SEQ ID NO: 2198 - DNA, 500 bp, Homo sapiens
gaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgtt

SEQ ID NO: 2199 - DNA, 500 bp, Homo sapiens
agagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaa

SEQ ID NO: 2200 - DNA, 500 bp, Homo sapiens
ctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacgg

SEQ ID NO: 2201 - DNA, 36 bp, Homo sapiens
tgctttccccatccacagctacaacagatgaggatg

SEQ ID NO: 2202 - DNA, 36 bp, Homo sapiens
cctgaggacatcatgaagctcttggagcagtcggag

SEQ ID NO: 2203 - DNA, 36 bp, Homo sapiens
cttttccgccctgcccaggccgcctggttgccaatc

SEQ ID NO: 2204 - DNA, 126 bp, Homo sapiens
gcataatcttggctcagtgaaacctttgcctcccaggttcaagcagttctcctgcctcagcctccggagtagctgggactacaggcacccacgacgatgcctggctaatttttagtagagctgggg

SEQ ID NO: 2205 - DNA, 36 bp, Homo sapiens
gcctacacgctggagcagcaggacgggatggaccgc

SEQ ID NO: 2206 - DNA, 36 bp, Homo sapiens
caggtcgccgcctgcccggactacccatcggtgggc

SEQ ID NO: 2207 - DNA, 500 bp, Homo sapiens
gttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagt

SEQ ID NO: 2208 - DNA, 36 bp, Homo sapiens
gcttttcaatcaacccaggcctggtgactcgactcc

SEQ ID NO: 2209 - DNA, 36 bp, Homo sapiens
cagcagggctgagatacggtgagcagtacaatcagg

SEQ ID NO: 2210 - DNA, 36 bp, Homo sapiens
ccgatgtgtggtcatttggtgtgctgatgtgggaag

SEQ ID NO: 2211 - DNA, 57 bp, Homo sapiens
ggtatccagtttgttttgggaggcagaaagccccagttacagcagggctgagatacg

SEQ ID NO: 2212 - DNA, 500 bp, Homo sapiens
gaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagt

SEQ ID NO: 2213 - DNA, 181 bp, Homo sapiens
actggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgt

SEQ ID NO: 2214 - DNA, 36 bp, Homo sapiens
ctggagtttcagccctcagtggaccctgatcaggac

SEQ ID NO: 2215 - DNA, 500 bp, Homo sapiens
gcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagaga

SEQ ID NO: 2216 - DNA, 237 bp, Homo sapiens
gcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaa

SEQ ID NO: 2217 - DNA, 500 bp, Homo sapiens
agccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggagg

SEQ ID NO: 2218 - DNA, 36 bp, Homo sapiens
tgtgctcagctactacaggtgccccgccccagctcc

SEQ ID NO: 2219 - DNA, 36 bp, Homo sapiens
gtgtccgcgacgtggagaatatcatggtggaagagt

SEQ ID NO: 2220 - DNA, 36 bp, Homo sapiens
ctatttttatgcctacagatatcatggtggaagagt

SEQ ID NO: 2221 - DNA, 36 bp, Homo sapiens
gacaagacgctgattgagaaagagagattctatgaa

SEQ ID NO: 2222 - DNA, 36 bp, Homo sapiens
ataagcttgaagagcagaatccagatattgtttcaa

SEQ ID NO: 2223 - DNA, 36 bp, Homo sapiens
atccgtgacttgggagagggccactttgggaaggtt

SEQ ID NO: 2224 - DNA, 36 bp, Homo sapiens
gagtatctgtttgctcagggacagtatgatttggtg

SEQ ID NO: 2225 - DNA, 386 bp, Homo sapiens
gaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaa

SEQ ID NO: 2226 - DNA, 504 bp, Homo sapiens
agctacacattatgtttggtctcctcagcctgatgctgtctgagtatctgacctaaaggcttccaagacaaagatggtcccacagggctctcagcagcctggaagaatatcgttgttcagaccagattgaagattgtgttctgcccagagggagtttgttgggccctcatctctaccagatccaaggactgtttctcacagagactcagtaggatgtggaagaagaaggccgtggctccgttggctcagggaacatctgccttttcccctcctgccacctcccctggcagtggagggtgacctgtctctctccttggcacctcatcagagattcttctctcttggacaacaccctccatcctcggaacccttttctttccttatctcgggaaaccttccatattgtacctacttctcattctcttattactgccttcctccgccatcaaacagcatttacccctcctgttggccattctgtcagaacccctctttgaacctctg

SEQ ID NO: 2227 - DNA, 504 bp, Homo sapiens
tccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactg

SEQ ID NO: 2228 - DNA, 500 bp, Homo sapiens
aaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgct

SEQ ID NO: 2229 - DNA, 500 bp, Homo sapiens
ggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagc

SEQ ID NO: 2230 - DNA, 500 bp, Homo sapiens
tcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgt

SEQ ID NO: 2231 - DNA, 89 bp, Homo sapiens
tcatcatggaatttctgccttcgggaagccttaaggaatatcttccaaagaataagaacaaaataaacctcaaacagcagctaaaatat

SEQ ID NO: 2232 - DNA, 226 bp, Homo sapiens
ggcccaacccatggccagatgacagtcacaagacttgtgaatacgttaaaagaaggaaaacgcctgccgtgcccacctaactgtccagatgaggtttatcagcttatgagaaaatgctgggaattccaaccatccaatcggacaagctttcagaaccttattgaaggatttgaagcacttttaaaataagaagcatgaataacatttaaattccacagattatcaa

SEQ ID NO: 2233 - DNA, 75 bp, Homo sapiens
ggcccaacccatggccagatgacagtcacaagacttgtgaatacgttaaaagaaggaaaacgcctgccgtgccca

SEQ ID NO: 2234 - DNA, 115 bp, Homo sapiens
aaatgctgggaattccaaccatccaatcggacaagctttcagaaccttattgaaggatttgaagcacttttaaaataagaagcatgaataacatttaaattccacagattatcaa

SEQ ID NO: 2235 - DNA, 36 bp, Homo sapiens
gtgtctgtggagacgagaatattctggttcaggagt

SEQ ID NO: 2236 - DNA, 44 bp, Homo sapiens
ttctgcagtctgtctggagagctgcccaggtttcccagccaaaa

SEQ ID NO: 2237 - DNA, 200 bp, Homo sapiens
ggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggct

SEQ ID NO: 2238 - DNA, 500 bp, Homo sapiens
taaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggct

SEQ ID NO: 2239 - DNA, 36 bp, Homo sapiens
agcaagaaggccatcaaggtagtccccatacccctg

SEQ ID NO: 2240 - DNA, 36 bp, Homo sapiens
gaaaaagaaaagaaatatgcaccatgactcctgtga

SEQ ID NO: 2241 - DNA, 500 bp, Homo sapiens
atggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccacca

SEQ ID NO: 2242 - DNA, 500 bp, Homo sapiens
ctagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaat

SEQ ID NO: 2243 - DNA, 500 bp, Homo sapiens
gtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctccc

SEQ ID NO: 2244 - DNA, 36 bp, Homo sapiens
gaagttcctctgtaccagttgctgtggttggctgat

SEQ ID NO: 2245 - DNA, 29 bp, Homo sapiens
ttctacttcgcatccgtccctttgtatca

SEQ ID NO: 2246 - DNA, 36 bp, Homo sapiens
cagccggcccgccgtggggcctccccagcccggctg

SEQ ID NO: 2247 - DNA, 36 bp, Homo sapiens
tgcaaggcatccctgagggagcctttgatgaagtga

SEQ ID NO: 2248 - DNA, 36 bp, Homo sapiens
ccaccattcccaccataggcttcaacgtggaaaccg

SEQ ID NO: 2249 - DNA, 36 bp, Homo sapiens
acttccagaacacacaaggcctgatcttcgtggtgg

SEQ ID NO: 2250 - DNA, 36 bp, Homo sapiens
gtgttcgccaacaagcaggacctccccaacgccatg

SEQ ID NO: 2251 - DNA, 381 bp, Homo sapiens
cttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcct

SEQ ID NO: 2252 - DNA, 89 bp, Homo sapiens
acagcaatgacagagagcgtgtgaacgaggcccgtgaggagctcatgaggatgctggccgaggacgagctccgggatgctgtcctcctg

SEQ ID NO: 2253 - DNA, 268 bp, Homo sapiens
gtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctg

SEQ ID NO: 2254 - DNA, 210 bp, Homo sapiens
aatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggct

SEQ ID NO: 2255 - DNA, 63 bp, Homo sapiens
acagcaatgacagagagcgtgtgaacgaggcccgtgaggagctcatgaggatgctggccgagg

SEQ ID NO: 2256 - DNA, 400 bp, Homo sapiens
tggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctc

SEQ ID NO: 2257 - DNA, 36 bp, Homo sapiens
atgaatgcggccgagatcacagacaagctggggctg

SEQ ID NO: 2258 - DNA, 436 bp, Homo sapiens
gtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgcc

SEQ ID NO: 2259 - DNA, 82 bp, Homo sapiens
gtaaatgtggcagacgcagcctgcggccaggctttttatttaatgtaaatagtttttgtttccaatgaggcagtttctggta

SEQ ID NO: 2260 - DNA, 500 bp, Homo sapiens
tcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcc

SEQ ID NO: 2261 - DNA, 36 bp, Homo sapiens
cgccacaggaactggtacattcaggccacctgcgcc

SEQ ID NO: 2262 - DNA, 36 bp, Homo sapiens
taaatgtggcagacgcagcctgcggccaggcttttt

SEQ ID NO: 2263 - DNA, 500 bp, Homo sapiens
tggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgca

SEQ ID NO: 2264 - DNA, 167 bp, Homo sapiens
cttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccatag

SEQ ID NO: 2265 - DNA, 278 bp, Homo sapiens
cttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaag

SEQ ID NO: 2266 - DNA, 500 bp, Homo sapiens
aagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctg

SEQ ID NO: 2267 - DNA, 227 bp, Homo sapiens
gtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgca

SEQ ID NO: 2268 - DNA, 305 bp, Homo sapiens
gcacagtggctcacgcctgtaatcccagcactttatgaatcccagcattcattagacgaggctgaggcaggtggatcccttgagcctaggagtttgagaccagcctgggcaacatggtgaaacccccatctctacaaaaaatccaaaaattagctgggagtggtggcgtgcacctgtagtcccagctactggggagtctgaggtgggaggattgattgagtccgggagattgaggctgcagtgagccatgatcactcattacactccagcccatgtgacaggcaagaccctgccgccaaaaaaaa

SEQ ID NO: 2269 - DNA, 340 bp, Homo sapiens
aaagcccgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaaagaaaagcccggagccatacactcacct

SEQ ID NO: 2270 - DNA, 248 bp, Homo sapiens
gagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgccttt

SEQ ID NO: 2271 - DNA, 327 bp, Homo sapiens
agagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagag

SEQ ID NO: 2272 - DNA, 500 bp, Homo sapiens
agagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccacc

SEQ ID NO: 2273 - DNA, 103 bp, Homo sapiens
ggcgtccagctgcatttcccacttctgactctgtgcctgctgttccctgctgggaagaaggaaagccagtgatgctggcttgaggctgtagtgggaggcccag

SEQ ID NO: 2274 - DNA, 36 bp, Homo sapiens
cggattgtgagaagccagcccgggcagtgagtgtgg

SEQ ID NO: 2275 - DNA, 500 bp, Homo sapiens
atggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccagagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatga

SEQ ID NO: 2276 - DNA, 36 bp, Homo sapiens
aactacagaggtcgcacggtggtggacggcagcagc

SEQ ID NO: 2277 - DNA, 60 bp, Homo sapiens
ttctctgagctgaagcaggagcagaagaaggtggatgagctcatcgccaaactggtgaaa

SEQ ID NO: 2278 - DNA, 36 bp, Homo sapiens
gtttcctcctggctccagcatccccagcaccgcaac

SEQ ID NO: 2279 - DNA, 36 bp, Homo sapiens
atcctggacatcatcaccatcatcatggtgcggctg

SEQ ID NO: 2280 - DNA, 36 bp, Homo sapiens
cccagggagcctgccgaggccccaccttcgccccgc

SEQ ID NO: 2281 - DNA, 36 bp, Homo sapiens
tgcgatttatggactttgtgcttggcgcccctgtgc

SEQ ID NO: 2282 - DNA, 36 bp, Homo sapiens
ctggaaatccgagaaaaggttttggggaaggatcac

SEQ ID NO: 2283 - DNA, 333 bp, Homo sapiens
ctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccg

SEQ ID NO: 2284 - DNA, 36 bp, Homo sapiens
atcaggagaacgtacacccggatgtgatgctggtac

SEQ ID NO: 2285 - DNA, 36 bp, Homo sapiens
ggtcctgctctttttgcaatcacaatcgaagcaatg

SEQ ID NO: 2286 - DNA, 36 bp, Homo sapiens
cagacactaactaaacaggacgaaaatgatgatgac

SEQ ID NO: 2287 - DNA, 516 bp, Homo sapiens
ctgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaa

SEQ ID NO: 2288 - DNA, 267 bp, Homo sapiens
cagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcaca

SEQ ID NO: 2289 - DNA, 198 bp, Homo sapiens
gatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccacta

SEQ ID NO: 2290 - DNA, 177 bp, Homo sapiens
aaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcaca

SEQ ID NO: 2291 - DNA, 75 bp, Homo sapiens
aaaagtgacattgatgaggtggctttacaagggatagaattctggtccaatgtctgtgatgaggaaatggatttg

SEQ ID NO: 2292 - DNA, 360 bp, Homo sapiens
gtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatg

SEQ ID NO: 2293 - DNA, 66 bp, Homo sapiens
ccccctgagcacaccagcaagttttatgcgaagggagcactacagtatctggttccaatcctcaca

SEQ ID NO: 2294 - DNA, 37 bp, Homo sapiens
gatgactggaacccctgcaaagcagcaggggtgtgcc

SEQ ID NO: 2295 - DNA, 26 bp, Homo sapiens
catatccagagcacatccgatagaat

SEQ ID NO: 2296 - DNA, 500 bp, Homo sapiens
cagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtg

SEQ ID NO: 2297 - DNA, 500 bp, Homo sapiens
tcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcac

SEQ ID NO: 2298 - DNA, 500 bp, Homo sapiens
tctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaa

SEQ ID NO: 2299 - DNA, 108 bp, Homo sapiens
tctgtgaagccgcagattctgtcagtgtttggtgatattgcccttgctattggaggagagtttaaaaaatacttagaggttgtattgaatactcttcagcaggcctcc

SEQ ID NO: 2300 - DNA, 36 bp, Homo sapiens; identical to SEQ ID NO: 2284

SEQ ID NO: 2301 - DNA, 500 bp, Homo sapiens
tgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtgga

SEQ ID NO: 2302 - DNA, 36 bp, Homo sapiens
ggagggcgaggatgcccagtgagtcccaggcccctc

SEQ ID NO: 2303 - DNA, 337 bp, Homo sapiens
tttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtgg

SEQ ID NO: 2304 - DNA, 234 bp, Homo sapiens
cctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaa

SEQ ID NO: 2305 - DNA, 500 bp, Homo sapiens
cgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttcccta

SEQ ID NO: 2306 - DNA, 42 bp, Homo sapiens
cttggccgaagcatagattgtaacccctccactcccctctga

SEQ ID NO: 2307 - DNA, 36 bp, Homo sapiens
gggaggctgaggcaggagaatcgcttgaacccggga

SEQ ID NO: 2308 - DNA, 91 bp, Homo sapiens
gagaacgcgccaccgcggggcccgggtgcagctagcgaccctctcgccacctgcgcgcagcccgaggtgagcagtgagcggcgagcgggag

SEQ ID NO: 2309 - DNA, 36 bp, Homo sapiens
agcagagcgaccaccgcccgggagcagcgcggcgag

SEQ ID NO: 2310 - DNA, 36 bp, Homo sapiens
aagcctctttgcaactgggtcagaatggtggcagcg

SEQ ID NO: 2311 - DNA, 197 bp, Homo sapiens
ctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctcc

SEQ ID NO: 2312 - DNA, 500 bp, Homo sapiens
aaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgc

SEQ ID NO: 2313 - DNA, 446 bp, Homo sapiens
ctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggctctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcc

SEQ ID NO: 2314 - DNA, 429 bp, Homo sapiens
ctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcag

SEQ ID NO: 2315 - DNA, 396 bp, Homo sapiens
aggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctg

SEQ ID NO: 2316 - DNA, 500 bp, Homo sapiens
gggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggctctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaaca

SEQ ID NO: 2317 - DNA, 500 bp, Homo sapiens
ctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggctctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaact

SEQ ID NO: 2318 - DNA, 276 bp, Homo sapiens
agctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaa

SEQ ID NO: 2319 - DNA, 89 bp, Homo sapiens
tccaggctggagtgcagcagcgcaatctctgtgtgatcattgcaaccttcacctcccaagttcaagcgattctcctgcctcagtctccc

SEQ ID NO: 2320 - DNA, 114 bp, Homo sapiens
gacagaggttgcagtgagctgagatcgcaccactgcactccagcctgggcgacagagcgagactccagctcaaaaaaataaataaaaattaaaaaataaaataaaataaaaaat

SEQ ID NO: 2321 - DNA, 213 bp, Homo sapiens
aggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattcca

SEQ ID NO: 2322 - DNA, 500 bp, Homo sapiens
aggaaaacaagcttaacacgcccactaattctacattatgctcctacctcccggcagcctctccaggcccagaactttctccagtcagcctctacagaccaagctcatgactcacaatggcctatttaggcccataccctatgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaaagtctgcctcacagcagattcttcacgcccagcatctacctcactgtggaccccccaagccaagctcccaacctttcagcagcttctacacacctagctcctgccaccca

SEQ ID NO: 2323 - DNA, 273 bp, Homo sapiens
aggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggccctgaacattctca

SEQ ID NO: 2324 - DNA, 59 bp, Homo sapiens
cagctccatcgttacaatggcctctttagacccagctcctgcctcccagccttctctcc

SEQ ID NO: 2325 - DNA, 500 bp, Homo sapiens
aaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcaaaacgtgggaacatccagttgcaggaaaacaagcttaacacgcccactgattctacattatgctcctacctcccggcagcctctccaggccgagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctcc

SEQ ID NO: 2326 - DNA, 500 bp, Homo sapiens
tcgtatacgtggattccagaggggtgacagcaaaacgtgggaacatccagttgcaggaaaacaagcttaacacgcccactgattctacattatgctcctacctcccggcagcctctccaggccgagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggctctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattcca

SEQ ID NO: 2327 - DNA, 304 bp, Homo sapiens
ctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggccctgaacattctcagtaagttcagatagctgggactgtaggtatacatgacgatacttggctaatttttaaattgttttgtagacacggggtctcactttgtt

SEQ ID NO: 2328 - DNA, 75 bp, Homo sapiens
ggctggagtgcagtggcgcgatctcggctcactgcaacctccgcctcccgggttcaagcagttctgcctcagcct

SEQ ID NO: 2329 - DNA, 63 bp, Homo sapiens
gatctcagctcactgcaacctctgccttctgggctcaagcgattctcctgcttcagccttctg

SEQ ID NO: 2330 - DNA, 194 bp, Homo sapiens
agttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctg

SEQ ID NO: 2331 - DNA, 77 bp, Homo sapiens
ggagttcagtggtcctatcatggctcattatagcctcaaactcccaggctcaagcaatcctaccatgtcagccttcc

SEQ ID NO: 2332 - DNA, 410 bp, Homo sapiens
acttctgaatccaggaagagagactgactgggcaacatgttattcagggtctccctctgttgtccaaggctggagtgtagtagtgctatcacagctgactgcagcctcaaccttccaggctgaagtgattctcccatctcaacctcccacgtggctgagactacaggtgcttgccaccatgcccaactaatatttggaattttcatataagtggattccagaggggtgacagcaaaacgtgggaccatccagttgcaggaaaacaagcttaacacgcccactgattttacattatgctcctaccacccggcagcctctccaggcccagaactttctccagtcagcctctacagaccaagctcatgactcacaatggcctatttaggcccataccctacctcacggcagtc

SEQ ID NO: 2333 - DNA, 36 bp, Homo sapiens
ttcaggtgatccatccacctcagcctcccaaagtgc

SEQ ID NO: 2334 - DNA, 36 bp, Homo sapiens
aaagaagaggagctgaatgcaataagaacagaaaat

SEQ ID NO: 2335 - DNA, 36 bp, Homo sapiens
acagggaagtggttacaggatcttcaagaagaaaat

SEQ ID NO: 2336 - DNA, 36 bp, Homo sapiens
gggtcagaggaggttaaggttctagagcacaagttg

SEQ ID NO: 2337 - DNA, 36 bp, Homo sapiens
ttcaaaatgctaattcaggtcagttatctctaacat

SEQ ID NO: 2338 - DNA, 26 bp, Homo sapiens
gcctaccttgacacatgctctccttc

SEQ ID NO: 2339 - DNA, 500 bp, Homo sapiens
aaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagagga

SEQ ID NO: 2340 - DNA, 107 bp, Homo sapiens
atgttggctaggatggtcttgatctcctgaccttgtgattcacttgcctcagcctcccaaagtgctgggattacaggtgtgagccaccacacccggccttgagttta

SEQ ID NO: 2341 - DNA, 497 bp, Homo sapiens
cacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaa

SEQ ID NO: 2342 - DNA, 500 bp, Homo sapiens
gccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaa

SEQ ID NO: 2343 - DNA, 166 bp, Homo sapiens
taaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcct

SEQ ID NO: 2344 - DNA, 500 bp, Homo sapiens
ggggagagccctacatcatctgctaccctgaaggatctggagagcccgtgccaagaactagcagtagtcccagactcgaggtctgtaaaagtcagtcaactgaagaacaccatcaaatctttgaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagatt

SEQ ID NO: 2345 - DNA, 36 bp, Homo sapiens
caggccaccgcccggaaggcctcccgccgcagccgt

SEQ ID NO: 2346 - DNA, 36 bp, Homo sapiens
cttcaagcccctcatcagcttcaagttcgggcagaa

SEQ ID NO: 2347 - DNA, 72 bp, Homo sapiens
atccacacagaagagccccgcgacagcccccaagcccatgcccccacggccccccctgcccaaccagcagtt

SEQ ID NO: 2348 - DNA, 93 bp, Homo sapiens
accagtacaatgagctgcacctgccagcagtcatcctcaagaccttcctccgggagcttcctgagcccctgctcacctttgacctctaccccc

SEQ ID NO: 2349 - DNA, 516 bp, Homo sapiens
tgctaccgctcccctccgctgtgctgggcgccgcccgcgctctggcgcccgcctgccgaacccgggcgctgcttcgtcttcctcaccgccaatctgtgcctgctccccgacgggcaagcgcgcttcggcaacctaccgcacagccagcgaccggccgaggccattggcgccgcgcggcccgcgctctacagggctacggactgcagccagccgtggtccagggcgccgcgcgggacgctggtggcctcgctgcccgtgggtctggactttgtgtgcctgcaggaggtattcgatctgcgcagggctcgtcgcttggtgaatcgcctggcgcccaacctgggcccgttgctgtacgacgtgggcacgctcggcctacagcccgggcggcacctcaagctgctggacagcgggctgctgctggcctcgcgctacccgctgctgcgcgccaccttccgttgcttcccccacgcacgtggcgaggacgcgctggcctccaagggactaccgtccgcacag

SEQ ID NO: 2350 - DNA, 500 bp, Homo sapiens
tcctcaccgccaatctgtgcctgctccccgacgggcaagcgcgcttcggcaacctaccgcacagccagcgaccggccgaggccattggcgccgcgcggcccgcgctctacagggctacggactgcagccagccgtggtccagggcgccgcgcgggacgctggtggcctcgctgcccgtgggtctggactttgtgtgcctgcaggaggtattcgatctgcgcagggctcgtcgcttggtgaatcgcctggcgcccaacctgggcccgttgctgtacgacgtgggcacgctcggcctacagcccgggcggcacctcaagctgctggacagcgggctgctgctggcctcgcgctacccgctgctgcgcgccaccttccgttgcttcccccacgcacgtggcgaggacgcgctggcctccaagggactaccgtccgcacaggtactggcctatccggtgcagcccgcagagggggcgggggttcggccgagaaggcggagaaag

SEQ ID NO: 2351 - DNA, 36 bp, Homo sapiens
actggggggctcttgaaggtgagacgagagaagagc

SEQ ID NO: 2352 - DNA, 36 bp, Homo sapiens
gacatgtcaggactgcgggagaaggatgacatccag

SEQ ID NO: 2353 - DNA, 116 bp, Homo sapiens
cttgagaattgtaactacgcggtagaattggggaagaatcaagcgaagttctccctggttggcatcggtggacaagatctcaatgaaggaaaccgcactctcacactggccttgat

SEQ ID NO: 2354 - DNA, 244 bp, Homo sapiens
gtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggcta

SEQ ID NO: 2355 - DNA, 500 bp, Homo sapiens
acatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctg

SEQ ID NO: 2356 - DNA, 97 bp, Homo sapiens
ttgtcaactggataaacaaagccctggaaaatgatcctgattgtcggcatgtcatcccaatgaacccaaacacgaatgatctctttaatgctgttgg

SEQ ID NO: 2357 - DNA, 513 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggca

SEQ ID NO: 2358 - DNA, 496 bp, Homo sapiens
gagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacag

SEQ ID NO: 2359 - DNA, 500 bp, Homo sapiens
ggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccatt

SEQ ID NO: 2360 - DNA, 496 bp, Homo sapiens
ctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcg

SEQ ID NO: 2361 - DNA, 36 bp, Homo sapiens
cagagctcagatttcaaggtgatggtgaacgggatc

SEQ ID NO: 2362 - DNA, 382 bp, Homo sapiens
cctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctcccc

SEQ ID NO: 2363 - DNA, 500 bp, Homo sapiens
aatcttgctgtgtttcccaggctggtctcaaactcctggccttgagcaatcctcctgcctcggccttccaaagttctgggattatagatgtcggccagtacacctgacctgaatgatttttttaaagttcaattaaaaaaaaaagtaacttgtttcttttaaagctaaagaaggaataaaaaataaacagtctgttcctgattcttacgcattgctaggaaaataattttgtcacctagaggagagaggttgatagatgatcagttgtgggtgtcaaatacacgaaggacgccgctggattctgttcaagtgcgctctgcaaagatggtggtcttctgctcatcaaatggtgtgtgagagtgtctgactgaggaagaatctttaaaatgctgtaagaaatcaggcttgtagtaagaaggaaatcacccaccagcagaaaaatgtatttccggcctttcttcctcaccctctgccactgttttaggattgctcagtttcat

SEQ ID NO: 2364 - DNA, 26 bp, Homo sapiens
accaagaatccagaactctcctacca

SEQ ID NO: 2365 - DNA, 36 bp, Homo sapiens
ctccccttccaccctcagtggatgataatctgaaga

SEQ ID NO: 2366 - DNA, 36 bp, Homo sapiens
ctccccttccaccctcagctctaccctcagcggatg

SEQ ID NO: 2367 - DNA, 36 bp, Homo sapiens
ccctcagcggatgataatcaagacacctcccgagtg

SEQ ID NO: 2368 - DNA, 253 bp, Homo sapiens
tgcacttacaatttggtattacctgggagtgaaaagaaatattacagccatgcctaactgacttcttgaggtcagaatggcggcagcggagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttcca

SEQ ID NO: 2369 - DNA, 229 bp, Homo sapiens
gagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctcccgagtgtctgctcactccccttccaccctcag

SEQ ID NO: 2370 - DNA, 50 bp, Homo sapiens
ataatctcaagacacctgccgagtgcctgctctatccccttccaccctca

SEQ ID NO: 2371 - DNA, 229 bp, Homo sapiens
gtcagaatggcggcagcggagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctcccgagtgtctgctca

SEQ ID NO: 2372 - DNA, 39 bp, Homo sapiens
cacctcccgagtgtctgctcactccccttccaccctcag

SEQ ID NO: 2373 - DNA, 500 bp, Homo sapiens
gaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcggagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctcccgagtgtgtctgctca

SEQ ID NO: 2374 - DNA, 79 bp, Homo sapiens
tccaccctcagcggatgataatctcaagacacctcccgagtgtctgctcactccccttccaccctcagctccaccctca

SEQ ID NO: 2375 - DNA, 500 bp, Homo sapiens
gacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctcta

SEQ ID NO: 2376 - DNA, 500 bp, Homo sapiens; identical to SEQ ID NO: 2375

SEQ ID NO: 2377 - DNA, 189 bp, Homo sapiens
gtcagaatggcggcagcggagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctca

SEQ ID NO: 2378 - DNA, 39 bp, Homo sapiens; identical to SEQ ID NO: 2372

SEQ ID NO: 2379 - DNA, 154 bp, Homo sapiens
gagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctct

SEQ ID NO: 2380 - DNA, 36 bp, Homo sapiens
tccccttccaccctcagcggatgataatctgaagaa

SEQ ID NO: 2381 - DNA, 500 bp, Homo sapiens
aagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcggagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctcta

SEQ ID NO: 2382 - DNA, 46 bp, Homo sapiens
ccctcagcggatgataatctcaagacacctcccgagtgtctgctca

SEQ ID NO: 2383 - DNA, 36 bp, Homo sapiens
tcaagacaccttccgagttgtctgctcactcccctt

SEQ ID NO: 2384 - DNA, 500 bp, Homo sapiens
aaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcggagcatcgtcattcttcaggattgccctgctggccctacctcacagctgaaactttaaaaaacaggatgggccaccagccacctcctccaactcaacaacattctataactgataactccctgagcc

SEQ ID NO: 2385 - DNA, 500 bp, Homo sapiens
caggagttcgagaccagcctggccaacacaatgaaaccctgtctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaa

SEQ ID NO: 2386 - DNA, 67 bp, Homo sapiens
ggaagggtgatattatgacactgacactgctattttgaaacctggaggatggaaaggtgcaaaaatc

SEQ ID NO: 2387 - DNA, 500 bp, Homo sapiens
attctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacgggg

SEQ ID NO: 2388 - DNA, 36 bp, Homo sapiens
cgttgcggcggcgggcagaggactactacagatgca

SEQ ID NO: 2389 - DNA, 500 bp, Homo sapiens
aagacatctttactttatggagacaggtggaaaccaaggttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcggagcatcgtcattcttcaggattgccctgctggccctacctcacagctgaaactttaaaaaacaggatgggccaccagcc

SEQ ID NO: 2390 - DNA, 36 bp, Homo sapiens
agcagtccaagatctccggctacagcacagagcact

SEQ ID NO: 2391 - DNA, 81 bp, Homo sapiens
aacctggccgagtttgcgggctcgggctccacggtgcgctgctgcctgctcgagggatatgacacgaagaacactcgccag

SEQ ID NO: 2392 - DNA, 103 bp, Homo sapiens
gattgtaagtttcctgaggcctccctagaagctgagcagatgccagcaccacgctttctgtacagcctaaggaactatgagccaatgaaacctcttttcttca

SEQ ID NO: 2393 - DNA, 500 bp, Homo sapiens
gagcatacctgatgaacagttacactcatttgcgggtttcaccatgttggccaggatggtcttgaactcctgacctcgtgatccacccaccttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattatgaagaaaagaaatggaggtgggagtttaaataactattcctcctccattccaccgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggcagagcca

SEQ ID NO: 2394 - DNA, 36 bp, Homo sapiens
atgacccacctctgcctcccaaagtgctgggattcc

SEQ ID NO: 2395 - DNA, 252 bp, Homo sapiens
ttttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacg

SEQ ID NO: 2396 - DNA, 36 bp, Homo sapiens
gtgtcgtggctcatgcctgtaatcccagcactttgg

SEQ ID NO: 2397 - DNA, 36 bp, Homo sapiens
aaagtgctgggattacaggctcctcattaggccaca

SEQ ID NO: 2398 - DNA, 36 bp, Homo sapiens
acccgccaccacgcccaggtaattttttatactttt

SEQ ID NO: 2399 - DNA, 554 bp, Homo sapiens
tccagtatgctgctcttctgaggatccggcaagatggcagaagtagagcagaagaagaagcggaccttccgcaagttcacctaccgcggcgtggacctggaccagctgctggacatgtcctacgagcagctggagcagccgatgcagctgtacagtgcgcgccagcggcggcggctgaaccggggcctgcggcggaagcagcactccctgctgaagcgcctgcgcaaggccaagaaggaggcgccgcccatggagaagcaggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcacggccggcccggcatcggggccacccactcctcccgcttcatccctctcaagtaatggctcagctaataaaggcgcacatgactccaaaaaaaaaaaaaaaaagaacaagagaaacaacaacaaaaata

SEQ ID NO: 2400 - DNA, 25 bp, Homo sapiens
ccgggaggcagaggttgcagtgagc

SEQ ID NO: 2401 - DNA, 1726 bp, Homo sapiens
atttgcaaagagattgctttgtcctgaatttcactctagaaattgcagaaaccaagacttccacgatgtctattaaacagatggtatacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggcgtacggcttcaggagtctcgaatcccacgggtgtacggcttcaggagtcttgaggggctcctttgagttgagagttgtggatccaagtctcagagcactgaagttttgtggcagagaagaacttgttatggtcccttccaatagagttcaaggacagtctttctctggtgtcatttccaaaggactcaatcgctgagttttggactctgagaaatctagttgtcatctgctggtgggtcatgaaggccccccctttttttctttttctttttctttttctttttttttttgagacagagtctcacttgatcacccaggctagagtgcagtggcgtgatcttgactcactgcaacttctgccacccaggttcaagcaattctcctgcctcagcctcccaagtagctgggattacaggcgcctgccaccacacctggctaatttttgtatttttagtagagacgggatttcatcatcttggccaggctggtcttgaactcctgacctcgtgatccgcctgcctcagcctcccaaagtgctgggattataggtgtgagccaccgcgcccggcctgcctttttttttttttttgttaacctagtgaaagtatgctttggcataatgcattaaagccttgcactactgaatcatagcagagtttataagagtagaagatacatgaggttctattcttaggggcataggccttccagtgactgtttcttttctttctttcttttttttttgagatggagtctcgctctgtcgccaggactggagtgcagtgacacgatcccggctcactgcaacctccacctcccaggttcaagcaattctccttcctcagcctcccgagtagctgggactacaggcgcgtgccatgacacccagctaattttttatttttaatagagatggggttgaaacccccatgttggccaggctggtctcaaactcctgacctcaggtgttctgccctcctcggcctcccaaagtgctgggattacaggcatgagccaccatgcccggcccagtgactgtttcataaggggtcaagttacattttccactgagaggggaatctgattgccatcaaggccaatggtaatactgttagccaaggcaatccagtcaattcacttaactttgccagtttcagttccaagatgccatttgtcctttcaacctttccagaagactaaaggtgatagcaacaatggtaatgccattgtgtttgtaacactttattttattgctttataactttccgagtaaaattggtatctctgtc

SEQ ID NO: 2402 - DNA, 36 bp, Homo sapiens
tcgatccgccacctcagcctcccagagtgctgggat

SEQ ID NO: 2403 - DNA, 36 bp, Homo sapiens
aggaccagcacagtccaggctttggagagaatcacc

SEQ ID NO: 2404 - DNA, 36 bp, Homo sapiens
ctagataccagttctctgggtcgtctaaggacagtt

SEQ ID NO: 2405 - DNA, 36 bp, Homo sapiens
ttggactttatttcacaggttgagggcaccatcctc

SEQ ID NO: 2406 - DNA, 155 bp, Homo sapiens
tacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagcc

SEQ ID NO: 2407 - DNA, 36 bp, Homo sapiens
gcctctccaggcccagaactttctccaatcagcctc

SEQ ID NO: 2408 - DNA, 36 bp, Homo sapiens
ttctctccaggccctgaactttctcaagtcgacctc

SEQ ID NO: 2409 - DNA, 263 bp, Homo sapiens
tctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggca

SEQ ID NO: 2410 - DNA, 36 bp, Homo sapiens
gcccagcctctgcctcccgtcggcctctacagtccc

SEQ ID NO: 2411 - DNA, 500 bp, Homo sapiens
aaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccag

SEQ ID NO: 2412 - DNA, 387 bp, Homo sapiens
aggaaaacaagcttaagacgcccactgattctacattatgctcctacctcccggcagcctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcc

SEQ ID NO: 2413 - DNA, 500 bp, Homo sapiens
aaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgc

SEQ ID NO: 2414 - DNA, 411 bp, Homo sapiens
ctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcatctgcctcactgtggaccccccaagccaagctcccaacctttcag

SEQ ID NO: 2415 - DNA, 500 bp, Homo sapiens
gtgacagtgaaacgtgggaccatccagttgcaggaaaacaagcttaagacgcccactgattctacattatgctcctacctcccggcagcctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcatctgcctcactgtggaccccccaagccaagctcccaacctttcag

SEQ ID NO: 2416 - DNA, 498 bp, Homo sapiens
gagggcctgaggccagtgcaagattcccagccgggctccaagggagcacagagccaagacctgaaccaggtctgcctgggccccgagccactgtccttcccacgaccccagcggccatttgccgtggccaataggatcaataaaacgcctggggtatctggccgctcggtggaaattgacccacgcagggcctttgctggccacaccgggccccttggatttaataagctttgggctttccaagagaaagccttggaagaggaatttgaaaaacttgcctcagctccagactttgcttctcactcactgggtgaccttgatctgtggctccgtttctctacctgcaaagaaaagggcataaagctgtatgagtggcgtttctgccacttggaactgaaggagtgtggatgtacctgtttccaggaagaggaatcgatggatttcatcaaattctccttgattcccccaaagactaagaagccctgctatggtttgaat

SEQ ID NO: 2417 - DNA, 416 bp, Homo sapiens
ccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctcc

SEQ ID NO: 2418 - DNA, 337 bp, Homo sapiens
cacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccaca

SEQ ID NO: 2419 - DNA, 112 bp, Homo sapiens
gttttacagcagttccaaccctggaatcaacacctttctcaggtgtagccaaccaaatccacactctgtgtgaaaggcccacatatggagaagtaaaggatggtgctttgga

SEQ ID NO: 2420 - DNA, 355 bp, Homo sapiens
gaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaata

SEQ ID NO: 2421 - DNA, 36 bp, Homo sapiens
cacttttcctcctgccaggcctcctgatcacttgcc

SEQ ID NO: 2422 - DNA, 36 bp, Homo sapiens
gccgggtcatccccaaaggcattatctgcctcatca

SEQ ID NO: 2423 - DNA, 36 bp, Homo sapiens
gtgtggccggaccctgaggtctatgacccctttcgc

SEQ ID NO: 2424 - DNA, 65 bp, Homo sapiens
gtgctggtgaaaagtggagccgccaccgtcggatgctgacgcctgccttccatttcaacatcctg

SEQ ID NO: 2425 - DNA, 500 bp, Homo sapiens
acaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgacgtcatccaggagcggcgccgcaccctccctagccagggtgttgatgacttcctc

SEQ ID NO: 2426 - DNA, 500 bp, Homo sapiens
gtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgacgtcatccaggagcggcgccgcaccctccctagccagggtgttgatgacttcctccaagccaaggccaaatccaagactttggacttcattgatgtactcctgctgagc

SEQ ID NO: 2427 - DNA, 500 bp, Homo sapiens
gcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctggccttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattac

SEQ ID NO: 2428 - DNA, 98 bp, Homo sapiens
gcccttcctgaccatgtgcattaaggagagcctgaggctgcatcccccagtccctgccgtctctcgctgctgcacccaagacattgtgctcccagacg

SEQ ID NO: 2429 - DNA, 36 bp, Homo sapiens
cccgcgcccgctgcgtgggtgagccgggcttcgggg

SEQ ID NO: 2430 - DNA, 500 bp, Homo sapiens
gcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgag

SEQ ID NO: 2431 - DNA, 36 bp, Homo sapiens
attgacttttctgctcagattgcagagggaatggca

SEQ ID NO: 2432 - DNA, 36 bp, Homo sapiens
gttgaaatgtcttcacaggtggtttttcaaggatat

SEQ ID NO: 2433 - DNA, 36 bp, Homo sapiens
ttggggaagtctggatgggttactataacaacagta

SEQ ID NO: 2434 - DNA, 117 bp, Homo sapiens
gcagaagattggagaaggcttgtattagtcccaagccacagaagccatgggataaagatgcctgggagatcccccgggagtccatcaagttggtgaaaaggcttggcgctgggcagt

SEQ ID NO: 2435 - DNA, 36 bp, Homo sapiens
cctcccaaagtgctgggaattacaggcgtgagccac

SEQ ID NO: 2436 - DNA, 36 bp, Homo sapiens
caggcctcgcgctgcccggccggctcctcgtgtccc

SEQ ID NO: 2437 - DNA, 500 bp, Homo sapiens
atggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgat

SEQ ID NO: 2438 - DNA, 500 bp, Homo sapiens
aacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaa

SEQ ID NO: 2439 - DNA, 500 bp, Homo sapiens
agtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttgg

SEQ ID NO: 2440 - DNA, 255 bp, Homo sapiens
aacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgat

SEQ ID NO: 2441 - DNA, 36 bp, Homo sapiens
gtggggagcagaataccgaaggcagacggtaacaag

SEQ ID NO: 2442 - DNA, 26 bp, Homo sapiens
tctcatgcctcagcttcccgagtagc

SEQ ID NO: 2443 - DNA, 36 bp, Homo sapiens
aatgtggccactgcccagggccggtattaccgcacc

SEQ ID NO: 2444 - DNA, 36 bp, Homo sapiens
tgcccaagaagcccactgccattaagactgagggaa

SEQ ID NO: 2445 - DNA, 36 bp, Homo sapiens
atagccccggccaaggatgtggctccgtccacagta

SEQ ID NO: 2446 - DNA, 36 bp, Homo sapiens
atggctctgggcaaggatgtgactccacctccagaa

SEQ ID NO: 2447 - DNA, 81 bp, Homo sapiens
ggctggagtgcaatggcgcgatctcggctcactgcgatctccgcctcctgggttcaagtgattctccttcctcagcctcct

SEQ ID NO: 2448 - DNA, 500 bp, Homo sapiens
ctcaacaacagtactggccagtctcctcaccacaaagtgcagagaagtgttttttcaagccaaaagcaaagacgctacagtgaccatgctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtagtaacacagcatctggtggaatgacacgacgaaatacttatgtttgcagtgagagaactacagctgatagacactcagtgattcagaatggcaaagaaaacagcactattcctgatcagagaactccagttgcttcaacacacagtatcagtagtgcagccaccccagatcgaatccgcttcccaagaggcac

SEQ ID NO: 2449 - DNA, 138 bp, Homo sapiens
ttaagagggaaatacagaattcccttctacatgtctacagactgtgaaaaccttctcaaacgtttcctggtgctaaatccaattaaacgcggcactctagagcaaatcatgaaggacaggtggatcaatgcagggcat

SEQ ID NO: 2450 - DNA, 36 bp, Homo sapiens
atcccgcctacctccctgaggagctgagtgccctgc

SEQ ID NO: 2451 - DNA, 66 bp, Homo sapiens
atggccaaagacaatgttcctttccatagcttagtctttccttgctcagccctaggagctgaggat

SEQ ID NO: 2452 - DNA, 36 bp, Homo sapiens
tcatgacttctgtccaaggtgtgctcggaaatctct

SEQ ID NO: 2453 - DNA, 371 bp, Homo sapiens
cggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaa

SEQ ID NO: 2454 - DNA, 67 bp, Homo sapiens
aaattgtgtactcctgtccttcatcgtcaaagtttgatgcagaaatgccacaccttcatttcaagct

SEQ ID NO: 2455 - DNA, 36 bp, Homo sapiens
tgctttgattcattgaaaggccgttgctccagggag

SEQ ID NO: 2456 - DNA, 36 bp, Homo sapiens
gccccattacaacccgtggtaagcatgttttcagtc

SEQ ID NO: 2457 - DNA, 36 bp, Homo sapiens
cgaacagacagacttgaggtatgtcgagagtaccaa

SEQ ID NO: 2458 - DNA, 36 bp, Homo sapiens
tgattttccctccgaaagttcccatggtgcacggtg

SEQ ID NO: 2459 - DNA, 36 bp, Homo sapiens
acagccacagccaaccagatacccataatatctgcc

SEQ ID NO: 2460 - DNA, 500 bp, Homo sapiens
aactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcg

SEQ ID NO: 2461 - DNA, 77 bp, Homo sapiens
ctacgccagccactgtgtccgcagcaacaacatctgccacaagtgttcccttcgctgcaacagccacagccaaccag

SEQ ID NO: 2462 - DNA, 59 bp, Homo sapiens
ctacgccagccactgtgtccgcagcaacaacatctgccacaagtgttcccttcgctgca

SEQ ID NO: 2463 - DNA, 31 bp, Homo sapiens
tctagttgcaggaaaacaagctcagggctcc

SEQ ID NO: 2464 - DNA, 36 bp, Homo sapiens
attttccaataccaacaggctctagccaacatgcag

SEQ ID NO: 2465 - DNA, 267 bp, Homo sapiens
ggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggctcaatattgtgcatgacacccgctacaagtgttgttcccatggtgcacggtgctacgccagccactgtgtccgcagcaacaacatctgccacaagtgttcccttcgctgca

SEQ ID NO: 2466 - DNA, 120 bp, Homo sapiens
tagtgactctaaacaaagaagaaagcagcactgtcatcagatgcatgataaaccaaaatatgaaaatgggaaatgtttaattaacctagtaattgggtgggttaagtacatgggtgaatt

SEQ ID NO: 2467 - DNA, 443 bp, Homo sapiens
aggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcag

SEQ ID NO: 2468 - DNA, 231 bp, Homo sapiens
tcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtat

SEQ ID NO: 2469 - DNA, 36 bp, Homo sapiens
ccccaggacacccccagcctcagcctcccaaagtgc

SEQ ID NO: 2470 - DNA, 36 bp, Homo sapiens
gcagagacctaccagccgatccagtctcccactttc

SEQ ID NO: 2471 - DNA, 500 bp, Homo sapiens
ctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctca

SEQ ID NO: 2472 - DNA, 36 bp, Homo sapiens
ccaaagccgctgtgaaaggctacctcggacctgaac

SEQ ID NO: 2473 - DNA, 60 bp, Homo sapiens
ggtttggatccagctcgagtcaacgtccctgtcattggtggccatgctgggaagaccatc

SEQ ID NO: 2474 - DNA, 129 bp, Homo sapiens
gccaccctctccatggcgtatgccggcgcccgctttgtcttctcccttgtggatgcaatgaatggaaaggaaggtgttgtggaatgttccttcgttaagtcacaggaaacggaatgtacctacttctcc

SEQ ID NO: 2475 - DNA, 36 bp, Homo sapiens
tagtagtcaatcagcaggaatcatcggactcaggta

SEQ ID NO: 2476 - DNA, 36 bp, Homo sapiens
catcctttacaccaactcctgcctcagcctcccaat

SEQ ID NO: 2477 - DNA, 36 bp, Homo sapiens
gacgagcggaaccgacaggtgactttcaccaagcgg

SEQ ID NO: 2478 - DNA, 36 bp, Homo sapiens
ccactgcctacaacacagattaccagttgaccagtg

SEQ ID NO: 2479 - DNA, 36 bp, Homo sapiens
cacttttcctccatgcagattaccagttgaccagtg

SEQ ID NO: 2480 - DNA, 36 bp, Homo sapiens
gaatgggaacttctgcaggacattggagacatcttg

SEQ ID NO: 2481 - DNA, 80 bp, Homo sapiens
ccctgaaaagtggaccactcctcaagagataaaacaaaagatccaactcctccaccagaagtcagagtttgtggagaaga

SEQ ID NO: 2482 - DNA, 36 bp, Homo sapiens
ttctgtcaggggagtgagtatttctaaatttgaaga

SEQ ID NO: 2483 - DNA, 36 bp, Homo sapiens
ttgagctccggaaagttggggtgaagctaagtagtc

SEQ ID NO: 2484 - DNA, 36 bp, Homo sapiens
aaaatggacaaaaaattggaaggcaacagcccccag

SEQ ID NO: 2485 - DNA, 500 bp, Homo sapiens
cagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttcc

SEQ ID NO: 2486 - DNA, 64 bp, Homo sapiens
aatccaatcacagctcactacagcctcagcctcccagactcaggtgatcccatctcagcctcct

SEQ ID NO: 2487 - DNA, 36 bp, Homo sapiens
gtccttggaaaccctcaatctgtcccagaacaacat

SEQ ID NO: 2488 - DNA, 36 bp, Homo sapiens
gtatattcatctaccatggtgaggtgccccaggcca

SEQ ID NO: 2489 - DNA, 500 bp, Homo sapiens
gtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaac

SEQ ID NO: 2490 - DNA, 291 bp, Homo sapiens
cgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacag

SEQ ID NO: 2491 - DNA, 357 bp, Homo sapiens
atgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatag

SEQ ID NO: 2492 - DNA, 349 bp, Homo sapiens
gctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaacc

SEQ ID NO: 2493 - DNA, 500 bp, Homo sapiens
tttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccc

SEQ ID NO: 2494 - DNA, 125 bp, Homo sapiens
gagcaccacagatgctcgcaagcgctgtgtatatacatgcaagatagtggagtgccgtcctccagtcgtagagccggatatcaacagcactgttgaacatgatgaaaacaggaccattgcccata

SEQ ID NO: 2495 - DNA, 36 bp, Homo sapiens
ggagagagtaaacatgtggtcgaggatttgattgca

SEQ ID NO: 2496 - DNA, 36 bp, Homo sapiens
tctatgcaacctacgatgatggtatttgcaagtcat

SEQ ID NO: 2497 - DNA, 36 bp, Homo sapiens
cagactgcataaaatcagctgctcgactgatccaaa

SEQ ID NO: 2498 - DNA, 345 bp, Homo sapiens
gtcagaaagtcagatggatataactgatatcaacactccaaagccaaagaagaaacagcgatggactcgactggagatcagcctctcggtccttgtcctgctcctcaccatcatagctgtgagaatgatcgcactctatgcaacctacgatgatggtatttgcaagtcatcagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgtttt

SEQ ID NO: 2499 - DNA, 236 bp, Homo sapiens
tgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcac

SEQ ID NO: 2500 - DNA, 135 bp, Homo sapiens
agtcagaaagtcagatggatataactgatatcaacactccaaagccaaagaagaaacagcgatggactcgactggagatcagcctctcggtccttgtcctgctcctcaccatcatagctgtgagaatgatcgcac

SEQ ID NO: 2501 - DNA, 500 bp, Homo sapiens
cagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctc

SEQ ID NO: 2502 - DNA, 500 bp, Homo sapiens
tcagatggatataactgatatcaacactccaaagccaaagaagaaacagcgatggactcgactggagatcagcctctcggtccttgtcctgctcctcaccatcatagctgtgagaatgatcgcactctatgcaacctacgatgatggtatttgcaagtcatcagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaa

SEQ ID NO: 2503 - DNA, 500 bp, Homo sapiens
tcgcactctatgcaacctacgatgatggtatttgcaagtcatcagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattct

SEQ ID NO: 2504 - DNA, 500 bp, Homo sapiens
tcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagca

SEQ ID NO: 2505 - DNA, 500 bp, Homo sapiens
cagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgc

SEQ ID NO: 2506 - DNA, 500 bp, Homo sapiens
aggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacact

SEQ ID NO: 2507 - DNA, 45 bp, Homo sapiens
aggatcggctatcctgatgacattgtttcaaatgataacaaactg

SEQ ID NO: 2508 - DNA, 500 bp, Homo sapiens
ataacaagatgagattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaa

SEQ ID NO: 2509 - DNA, 500 bp, Homo sapiens
caaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactg

SEQ ID NO: 2510 - DNA, 500 bp, Homo sapiens
tattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgaga

SEQ ID NO: 2511 - DNA, 500 bp, Homo sapiens
cagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactctt

SEQ ID NO: 2512 - DNA, 500 bp, Homo sapiens
atggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacacc

SEQ ID NO: 2513 - DNA, 500 bp, Homo sapiens
ctgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggaggga

SEQ ID NO: 2514 - DNA, 500 bp, Homo sapiens
aaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaa

SEQ ID NO: 2515 - DNA, 41 bp, Homo sapiens
aggccagagtatgcggttaactccattaaaacagatgtgca

SEQ ID NO: 2516 - DNA, 500 bp, Homo sapiens
gtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactattt

SEQ ID NO: 2517 - DNA, 36 bp, Homo sapiens
gcattcagtctctctacggacctccccctgcctcta

SEQ ID NO: 2518 - DNA, 36 bp, Homo sapiens
gctgtatgcctacccgcggcctgccggctcccccca

SEQ ID NO: 2519 - DNA, 61 bp, Homo sapiens
atctcggctcaccacaacctccgcctcccgggttcaagtgattctcctgccttagcctccc

SEQ ID NO: 2520 - DNA, 333 bp, Homo sapiens
gacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 2521 - DNA, 36 bp, Homo sapiens
cacagatgtagaacagtggacagaaatggaaatatt

SEQ ID NO: 2522 - DNA, 163 bp, Homo sapiens
ccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaagg

SEQ ID NO: 2523 - DNA, 104 bp, Homo sapiens
tgcttctggcctgtttctggattctaagggtagaaccagcataaaactagtcagtccaagtatttctaaagatccacagacacagttctcctggatttgggaag

SEQ ID NO: 2524 - DNA, 500 bp, Homo sapiens
attttattttattattttttgagacagtctcattctgtcatccaggctggaatgctgtggcgcaatctcggctcactgcaaactctgccccctgggttcaagctattctcctgcctcagcccacctagtagctgggattacaggtgtgtgccaccacactcagctaatttttttgtatttttagtagagacgaggtttcaccatgttagccaggatggtttcaaactcctggcctcatgtgattcacccaccttggcctctcaaagtgctgggattataggcataagccacagtgcccagccctaatttgagtttcagagggcaatttgtaccgtttggaaaagatgctggatccttcaatattactgctttagaaagatttggaactctgacccatatttagtacatgacctttctggggcgtggaaaaatatgctctgtcatctaatgtgatgtcaattttctttaaccttccatgtaaatagtgcgcattaagacat

SEQ ID NO: 2525 - DNA, 253 bp, Homo sapiens
ggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggat

SEQ ID NO: 2526 - DNA, 500 bp, Homo sapiens
tgtggaaaagagaaagtgcctactaaaacagttggagagagcagaggttcgcctggaagggatagatacaattttaaaattgtatctggtgagcaagaatttcttacttccatctgtgccatatgcaatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtatccagccggttcccctgcaaaccatcaccaatgagaacccatcgggaccgagcctggggaccatcccgcaagcccacttcctcctggtgatgctcagcatgctcaccctgcagcacagcgcaaacaaccttgacctcctgctcaattccggcacgctggccctcgctcaga

SEQ ID NO: 2527 - DNA, 57 bp, Homo sapiens
ttagccaggctggtcttgaactccagacctcaagggatccgcctgcctcagctttcc

SEQ ID NO: 2528 - DNA, 36 bp, Homo sapiens
tccccttccaccctcagcggatgataatctcaagac

SEQ ID NO: 2529 - DNA, 36 bp, Homo sapiens
gcggatgataatctcaagacacctcctgagtgtgtc

SEQ ID NO: 2530 - DNA, 500 bp, Homo sapiens
tttgtttttgtttttgtttttctgagatggagtctcgctgtgtcacccaggctggagtgcaatgacgtgatcttggctcattgcaacctctgcctcccaggttcaaatgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttacagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagag

SEQ ID NO: 2531 - DNA, 36 bp, Homo sapiens
acagtcccatccctgttggtaaccgtgttgcgcaaa

SEQ ID NO: 2532 - DNA, 26 bp, Homo sapiens
ccaccctcagcggatgataatctcaa

SEQ ID NO: 2533 - DNA, 36 bp, Homo sapiens
gcggatgataatctcaagacacctcccgagtgtctg

SEQ ID NO: 2534 - DNA, 500 bp, Homo sapiens
gacttttctttaccccccagttgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacctgccgagtgtctgctcac

SEQ ID NO: 2535 - DNA, 500 bp, Homo sapiens
cattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaagctatcatctcagaagtcagcaggcagtaagcaagaggaggaatcaatacagcaacagtttggatcagactgtacagttttttttgtttttgtttttgtttttgtttttctgagatggagtctcgctgtgtcacccaggctggagtgcaatgacgtgatcttggctcattgcaacctctgcctcccaggttcaaatgattcccctgcctcagcctcccgagtagctgggattacaggtgcctgccaccacccccgcctaattttttgtatttttagtagagacggg

SEQ ID NO: 2536 - DNA, 299 bp, Homo sapiens
gagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacctgccgagtgtctgctcactccccttccaccctcagc

SEQ ID NO: 2537 - DNA, 500 bp, Homo sapiens
ccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggttgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttt

SEQ ID NO: 2538 - DNA, 100 bp, Homo sapiens
taatctcaagacacctcccgagtgtctgctcactccccttccaccctcagcggatgataatctcaagaaactaatgaagaataaataaataatataaaaa

SEQ ID NO: 2539 - DNA, 51 bp, Homo sapiens
taatctcaagacacctcccgagtgtgtctgctcactccccttccaccctca

SEQ ID NO: 2540 - DNA, 34 bp, Homo sapiens
agcatgacgtgaggccgtggatgcaggcattaag

SEQ ID NO: 2541 - DNA, 69 bp, Homo sapiens
ttcctgtcccatgaccagggccagctcaccaaggagctgcagcagcatgtaaagtcagtgacatgccca

SEQ ID NO: 2542 - DNA, 358 bp, Homo sapiens
caccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcac

SEQ ID NO: 2543 - DNA, 36 bp, Homo sapiens
tcaagacacctcccgagtgtctgctcactccccttc

SEQ ID NO: 2544 - DNA, 115 bp, Homo sapiens
cttccaccctcagcggatgataatctcaagacaccttccgagcgtcagctcactccccttccaccctcagctccaccctcagcagatgataacatcaagacacctgccttccacc

SEQ ID NO: 2545 - DNA, 222 bp, Homo sapiens
acacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaacca

SEQ ID NO: 2546 - DNA, 36 bp, Homo sapiens
ccctcagctccaccctcagcagatgataatatcaag

SEQ ID NO: 2547 - DNA, 36 bp, Homo sapiens
tcatcacccgaacccaagaggcggagggtcggtgat

SEQ ID NO: 2548 - DNA, 119 bp, Homo sapiens
ctccaccctcagcagatgataatatcaagacacctgccgagcgtctgcgggggccgcttccaccctcagcggatgataatctcaagacaccttccgagcgtcagctcactccccttcca

SEQ ID NO: 2549 - DNA, 26 bp, Homo sapiens
tgccctgactacaattggaaatgcca

SEQ ID NO: 2550 - DNA, 26 bp, Homo sapiens
atgacttgggctttggaagtagctgt

SEQ ID NO: 2551 - DNA, 36 bp, Homo sapiens
ggccagcctgcagtgacagtgagacatggctttgac

SEQ ID NO: 2552 - DNA, 71 bp, Homo sapiens
agcattatgatggtggtagaagcactatgtgaacttcattgtcctgaagctatacagggaattgctgtctg

SEQ ID NO: 2553 - DNA, 30 bp, Homo sapiens
tgctgtccaaaccgactgactcttcccctg

SEQ ID NO: 2554 - DNA, 125 bp, Homo sapiens
gtttgaaaaggcctctgtggagtaccaggaacacctgtgtgccatgacaggtgttgattgctgcatctccagctttgacaaatcggtgctcaccttagccagtgctgggtgtaagagtgccagcc

SEQ ID NO: 2555 - DNA, 69 bp, Homo sapiens
ggccagctcaccaaggagctgcagcagcatgtaaagtcagtgacatgcccatgcgagtacctgaggaag

SEQ ID NO: 2556 - DNA, 68 bp, Homo sapiens
gcttccaccctcagcggatgataatctcaagacaccttccgagcgtcagctcactccccttccaccct

SEQ ID NO: 2557 - DNA, 36 bp, Homo sapiens
taatatcaagacacctgccgagcgtctgcgggggcc

SEQ ID NO: 2558 - DNA, 500 bp, Homo sapiens
gataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagc

SEQ ID NO: 2559 - DNA, 108 bp, Homo sapiens
cttccaccctcagcggatgataatctcaagacaccttccgagcgtcagctcactccccttccaccctcagctccaccctcagcagatgataacatcaagacacctgcc

SEQ ID NO: 2560 - DNA, 378 bp, Homo sapiens
ttgtgccactgcactccagcctggacagaaatgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccttggaagag

SEQ ID NO: 2561 - DNA, 322 bp, Homo sapiens
ataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatga

SEQ ID NO: 2562 - DNA, 36 bp, Homo sapiens
gataatctcaagacacctcccttagctactcaggag

SEQ ID NO: 2563 - DNA, 131 bp, Homo sapiens
ctgccgagcgtctgcgggggccgcttccaccctcagcggatgataatctcaagacaccttccgagcgtcagctcactccccttccaccctcagctccaccctcagcagatgataatatcaagacacctgcc

SEQ ID NO: 2564 - DNA, 89 bp, Homo sapiens
gcggatgataatctcaagacaccttccgagcgtcagctcactccccttccaccctcagctccaccctcagcagatgataatatcaagac

SEQ ID NO: 2565 - DNA, 62 bp, Homo sapiens
agccattttgggtagctgatcttgcattttctacgcctctacttggtcagtttctagaagac

SEQ ID NO: 2566 - DNA, 500 bp, Homo sapiens
tctggggaatcagtggatgaagacgtccctcctccatcagtgtcattaccaaagctggctgcgcttctccgggtatttagtactgtggtgaggagcactggggaaagcctcagcccaattcgggccctccaattactgaggcatacgtaacagatgtctgtacagagtaatgagatgtgtgacggctgcaaaccaggtgtttttttctgaggctgtgttgacagctgctaatgagcgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccgtg

SEQ ID NO: 2567 - DNA, 186 bp, Homo sapiens
tgtgtgacggctgcaaaccaggtgtttttttctgaggctgtgttgacagctgctaatgagcgtgttggtgttttgctcggcagcttggatcctagcatgactatacattgtgacatggtcattacatatggattagaccaactggagaattgccagacttgtggtaccgattatatcatctcagtc

SEQ ID NO: 2568 - DNA, 500 bp, Homo sapiens
atatctgtctgcaggcatgcagcagtctacatgctctatcctcttccttgccagatgatcttttacagagatgtgttgatgtttgccgtgttcaactagtgcaccgtggaacttgtattcgacaagcatttggaaaactgttgaaatcaattcctttaggtgttgtcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttc

SEQ ID NO: 2569 - DNA, 500 bp, Homo sapiens
tgttcaactagtgcaccgtggaacttgtattcgacaagcatttggaaaactgttgaaatcaattcctttaggtgttgtcctaagcgataacaatcacacagaaattcaagaaatttctttagcattaagaagtcacatgagtaaagcaccaagtaatacattccacccccaagatttctctgatgttattagttttattttgtatgggaactctcatagaacagggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcaggtcacacattaaaccctgatcaggatgttagtcagtggacaactgcagacagtg

SEQ ID NO: 2570 - DNA, 164 bp, Homo sapiens
aagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagaca

SEQ ID NO: 2571 - DNA, 499 bp, Homo sapiens
caggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggag

SEQ ID NO: 2572 - DNA, 500 bp, Homo sapiens
ggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggc

SEQ ID NO: 2573 - DNA, 166 bp, Homo sapiens
tgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagc

SEQ ID NO: 2574 - DNA, 122 bp, Homo sapiens
cccctgttctcattctgcaaatggtgaagctctctattgtcctgaccccacagttcctgtcccatgaccagggccagctcaccaaggagctgcagcagcatgtaaagtcagtgacatgccca

SEQ ID NO: 2575 - DNA, 500 bp, Homo sapiens
ctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgc

SEQ ID NO: 2576 - DNA, 113 bp, Homo sapiens
ctgccgagcgtctgcgggggccgcttccaccctcagcggatgataatctcaagacaccttccgagcgtcagctcactccccttccaccctcagctccaccctcagcagatgat

SEQ ID NO: 2577 - DNA, 258 bp, Homo sapiens
tacagtagtgctatcacagctcactgcagccttgaactcctgggctaaggatcctcctacctgagcctcctgagtagctgggactggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattcca

SEQ ID NO: 2578 - DNA, 433 bp, Homo sapiens
aggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagt

SEQ ID NO: 2579 - DNA, 410 bp, Homo sapiens
ctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcgg

SEQ ID NO: 2580 - DNA, 77 bp, Homo sapiens
ttttgctcttgttgcccaggctggagtgcaatggtggcgatctcggcctgctgcaacctccgcttcctgggttcaag

SEQ ID NO: 2581 - DNA, 93 bp, Homo sapiens
aggagaatcatttgaacccgggaggcagaggttgcggtgagctgagatcgcgccactgcactccagcccggcgacagagcgagaatctgtctc

SEQ ID NO: 2582 - DNA, 333 bp, Homo sapiens
gtttacctaagcaagcctgggcaatggcgggcgcccctcccccagcctccctgccgccttgcagtttgatctcagactgctgtgctagcaatcagcgagactccgtgggcgtaggaccctccgagccaggtgcgggatatcatctcgtggtgcgccgtttaagccagtcggaaaagcgcagtattcgggtgggagtgacccgattttccagctctcatcctggagagatggtttccctcatgctgggacagttctggggcagttcagaattgccaggactgtggattcccagcagcttggcctggtggacacacggaatgcaagacaacagca

SEQ ID NO: 2583 - DNA, 36 bp, Homo sapiens
ggtctcgacctcctgacctcgtgatccacccgtctc

SEQ ID NO: 2584 - DNA, 36 bp, Homo sapiens
gtcactttgcctccccaggtcaccatcctctcactc

SEQ ID NO: 2585 - DNA, 907 bp, Homo sapiens
cttcattttttgcttgtgttttttgaggttatatgaaacgttttaaatgtgacctgggagaagagtgaaatagagttttaacttaaccaggatgcatgattttaaaaatcgaagtaggcctgaatttcctgaaaattttaaaataatctagtagtgccagcatgaaccttagtcacttaggcaatagagaaggttttcatggaaatccattggtctgttttaaataaataccttgaatattaatagtataaaagagcattatctaagtaatactgaagcttattatcagctgaaactttcttgatcatgatggttagccatttacgctcacatctgttaacaatggtgattgctttcatcaggaaaacaacctttagatatgcaaatagctctttctgaggatccggcaagatggcagaagtagagcagaagaagaagcggaccttccgcaagttcacctaccgcggcgtggacctggaccagctgctggacatgtcctacgaacagctgatgcagctgtacagtgcgcgccagcggcggcggctgaaccggggcctgcggcggaagcggcactacctgctgaagcgcctgcgcaaggccaagaaggaggcgccgcccatggagaagccggaagtggtgaagacgcacctgagggacgtgatcatcctgcccgaggtggtgggcagcatggtgggcgtccacaacggcaagaccttcaaccaggtggaggtcaagcccgagatgattggccactacctgggcgagttctccatcacctacaagcccgtaaagcaatgccggtccggcatcggcgccacccactccttctgcttcatccctctcaagtagtggctcagctaataaaggcgcacatggttccaaaaaaaaaaaaaaaaagatatgcaaa

SEQ ID NO: 2586 - DNA, 1621 bp, Homo sapiens
attccttcaaaatattattgctcattgacaacacacctgatcacccaagagctgtgatggagatgtacaaggagattaatgttgttttcatgcctgctaacacaacatccattctgcagcccactgatcaaggagtaactttgacttttaagtcttatttaagaaatatatttcataaggctatagctaccatagatagtgattcctctgatggatctaggcaaagtaaattgaaaaccttctggaaaggattcatcattctagatgccattaagaacattcgtgattcatgggagatcaaagtatcaacatgaataggagtttgaaagatgattccagccctcacagatgactttgagggatttcagacttcaacggaggaaataactgcagatatggtggaaacagtaagagaactagaattagaaggggagtctgaagatgtgactcaattcctgcaatctcataagaaaactttaactaatgagaagttgtttcttatggacgggaaaagaacgtggtttcttgagatggaatctactcctggtgaagatgctatgaacactgtcaaaatgacaacaaaggatttaaaatatgacagaagcttaattgataaagcagggtttgagaggactgactccaattttgaaagaagtcatactgtgggtaaaatgctatcaaatagcatcatgtgctatagagacatcttttatgaaagggagagtcaactaatgcagcaaacttcattattatcttatgaaattgcgatagccaccccaaccttcagtaactactaccctgattggtcagcacccatcaacattgtggcaagaccctctaccagcaaaaagattatgacttgctgaaagctgagatgatcgttagcattttttagcaataaatatttttaattaaggtatgtatgttttttagacaattctattacacattttatagactacagtatagtataaacacagctttttttttttttttttttttttaagaaatggggtctcatgctgtcatccaggctggagtgcggtggtgcaatcatgactcactgcagcctcaaactcctgagctcaagtgatccaagtagctgggactacaggcctgtcacatcacacccggccaaaacgcataacttttatatgcaatgggaaacaaaaaaatgtgtgtgactcactctattgtgatattcagtttactgcagtgatatggaactaagcccacaatatccctgcggtatggctgtacagtataagaatcacctgaagggcttattaaaaacagcttgcttgaccccctcccttagagattccgattcagtagatctgggttggtcaagaatttgcatttctaacaagctcccagctgaggctgaggctgccattcaacatactaccaagtagcactggcatagagagatccctggaataaaatttacctacttgtgtgtgtgtgtatgaatgtgtgtgtgtgtgtgtgcgtgtgcatgtgcgtgtgtgtgtatacagtcttgctctgttgcctgggctggagtgcagtggcgtgatctcggctcaccataacctccgcctcccagctttcaagcgattctcatgccttagcctcctga

SEQ ID NO: 2587 - DNA, 500 bp, Homo sapiens
gtaacactggaatggatgtgaagatgggagaggtctacccatagcccattctacagagcagaactgaggctcagatattgaggtagattaaagatggctgccagttcagtgccacttgtcccgttgaactgtgaagtcttatccccctccttgggtctgcaccagccttgatgacttgctcactacaatgtggtagaagtgatggtgcatgacttccaaggttagatcagaagaagccttgaagttcctgccttggtctcttgaaacaacttaccgtgtaagaagtctgacaccctgagaccgccatgttggcacagttatgggtggatgctccagtagatggatccagctgagcccagccctccagccattcccacccccaaaccatgggtgaaactgtcttggaccctccagtccagcccactcaacatctaaataccacagactgacctcagctgataccatcacccagttaaaatgtgcctgaaactgacccacaa

SEQ ID NO: 2588 - DNA, 500 bp, Homo sapiens
tgtcaccacggccatcgttccctctgccacgctccctcctcagtgtcaccacggccatcgttccctctgccacgctccctcctcagtgtcaccacggccatcgttccctctgccacgctccctcctcagtgtcaccacggccatcgttccctctgccacgctccctcctcagtgtcaccacggccatcgttccctctgccacgctccctcctcagtgtcaccacggccatcgttccctctgccacgctccctcctcagtgtcaccatggccatcgttccttctgccacgctccctcctcaatgtcagccatggccatcgttccctctgccagctccctcctcaatgtcagccatggccatcgttccctctgccacgctccctcctcagtgtcaccatggccatcgttccctctgccacgctccctcctcagtgtcaccatggccatcgttccctctgccacgctccctcctcagtgtcaccatggccatcgttccctctg

SEQ ID NO: 2589 - DNA, 328 bp, Homo sapiens
ctgcatcttggtggcccctccaggcccagcctgtgcctcccgtcggcctctacaatcccaacatctgcctcacagcagattcttcacgcccagcctctgcctcacagtggaccctccagacccagatggtgtctcactgtggcatcctcaggcgaagctcctgcctttcagcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgca

SEQ ID NO: 2590 - DNA, 500 bp, Homo sapiens
aggaaaacaagcttaacacgcccactgattctacattatgctcctacctcccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccaactcctgcatcttggtggcccctccaggcccagcctgtgcctcccgtcggcctctacaatcccaacatctgcctcacagcagattcttcacgcccagcctctgcctcacagtggaccctccagacccagatggtgtctcactgtggcatcctcaggcgaagctcctgcctttcag

SEQ ID NO: 2591 - DNA, 500 bp, Homo sapiens
gcggccacggcctccgggggcctagaggtgcctctccagcgaccacctctgccgacactatatccctcaggacctgttcgattcaactcctccgccggcctcctctctggcgctcgggacactgtcgagcttcgccgactagcaacgacccacgtagaggccttgggagctcctccgtggtgggacattgttccaagaaggggcgcgtccgacgtcgttgccgtccagctctgcaccacctgaccgtgacgtcgtaagagtagcgtgccagggaagccacgcagccgctacttaaggagcccgcacgaggctagcccccccgcccacgctctctatcccgcccacttcgcactgatttcacgcagccattggccaagacggggtgtcgccgtgttgcccaggcaggtcttgaactcttggcttctggcttcaagtgatcttccagcctcggcctcccaaagtgctgggattacagtcagccactgcaccggaaatgtttt

SEQ ID NO: 2592 - DNA, 86 bp, Homo sapiens
gcccaggctggagtacagtggtgcgatcttggctccctgcaacttctgcctcccaggttcaagcgattttcctgcctcagcttcct

SEQ ID NO: 2593 - DNA, 62 bp, Homo sapiens
gtaagtttcctgaggcctcaccagaagctgagcagatgccagcaccatgctctctgtactgc

SEQ ID NO: 2594 - DNA, 500 bp, Homo sapiens
tgcccaggctggagtacaatggcatgatctcggctcaccgcgacctccgcctcccgggttcaagcgattctcctgcctcagtcttcccaagtggctgggattacaggcatgcgccactatgcctggctaattttgtatttttagtagaggcggggtttcttcatgttggtcagtctggtctcgaacttccagcctcaggtgatccgcccgcctcggcctcccaaagtgctgggattacaggtgtaagccaccgcgatggcctgctgtgttttaattttctgacatcccctttgactcatggattggttacgcatgtgttattcagtttctacatactggattcttcaaatttccttatattgttgctttgtaatttgagtccatcctagttagagaatatactttgtatggtttaaatccttttaattatattaattcttgttttatggcctaatatagggtctctggataatgttccatattgacttcaaaaagtgttt

SEQ ID NO: 2595 - DNA, 36 bp, Homo sapiens
gcccaaccgccatggcaggtgcagatctttgcctcc

SEQ ID NO: 2596 - DNA, 36 bp, Homo sapiens
cagtctgccttgtaacagaaactggcgatggaatat

SEQ ID NO: 2597 - DNA, 451 bp, Homo sapiens
tacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 2598 - DNA, 500 bp, Homo sapiens
gagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattag

SEQ ID NO: 2599 - DNA, 500 bp, Homo sapiens
cagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacag

SEQ ID NO: 2600 - DNA, 432 bp, Homo sapiens
acacaggctgtttcagcaccaggtattcttaacagaccacctgcaccaacagcaactgtacctgctccacagcctccagttacgaagcctcttttctccagtgctggacaggctcaggcagctgtccaaggacctgttggtacagatttcaaacccttaaatagtacccctgaagcaactacagcatccccaaagcctatgttctctgcttatacacagtctgcagattcaaccactagtacaacaaatagtactgcagctaaaccagcagcttcaataacaagtaagcctgctacacttgtaacaaccaatgcaaccaggaccgccaacagtgcccccttaccagagtgggcctcctcgacctccaatgggaatgagacctcctgtaatgctgcaaggtggccagtactgatcttacctcatccagtctaa

SEQ ID NO: 2601 - DNA, 36 bp, Homo sapiens
tgtgatggtgccagggccgttaagagtggacagagc

SEQ ID NO: 2602 - DNA, 36 bp, Homo sapiens
tgaacaaaattaaccgtgcccagcctgttcagtgga

SEQ ID NO: 2603 - DNA, 54 bp, Homo sapiens
aaggccagccatgcctcccacacagctgcccaggctgggcttcctgacaagctt

SEQ ID NO: 2604 - DNA, 36 bp, Homo sapiens
gacctcgtgacccgccctcctcggcctcccagagtg

SEQ ID NO: 2605 - DNA, 36 bp, Homo sapiens
gtgccctgcgacgctgcggtgagcactagtgacgct

SEQ ID NO: 2606 - DNA, 36 bp, Homo sapiens
atctcctttcctccccaggctgctgctcctgctgcc

SEQ ID NO: 2607 - DNA, 160 bp, Homo sapiens
atacaaagttagccaggcatggtggcacatacctgtaatcccagctacttgggaggctgaggcaggagaatcacttgaacccgggaggtggaggtagtggtgagccgagattgtgccattgcactccagcctgggcaacaaaagcgaaactccgtctcaa

SEQ ID NO: 2608 - DNA, 36 bp, Homo sapiens
accctgaaggccgagcaggaggagtatgtgcaggaa

SEQ ID NO: 2609 - DNA, 327 bp, Homo sapiens
gtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatc

SEQ ID NO: 2610 - DNA, 422 bp, Homo sapiens
gtgaacgggcagaagcagggccatgcccaagccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaa

SEQ ID NO: 2611 - DNA, 54 bp, Homo sapiens
ctgcagtccaacccgctgctcgaggccttcggcaacgccaagactgtgcgcaac

SEQ ID NO: 2612 - DNA, 500 bp, Homo sapiens
caaaatctttttgaggagaaatatgctccccggcctatctttatttcagggacgatcgttgataaaagtgggcggactctttccggacagacaggagagggatttgtcatcagcgtgtctcatggagaaccactctacattggattaaattgtgctttgggtgcagctgaaatgagaccttttattgaaataattggaaaatgtacaacagcctatgtcctctgttatcccaatgcaggtcttcccaacacctttggtgactatgatgaaacgccttctatgatggccaagcacctaaaggattttgctatggatggcttggtcaatatagttggaggatgctgtgggtcaacaccagatcatatcagggaaattgctgaagctgtgaaaaattgtaagcctagagttccacctgccactgcttttgaaggacatatgttactgtctggtctagagcccttcaggattggaccgtacaccaactttgttaacattggaga

SEQ ID NO: 2613 - DNA, 182 bp, Homo sapiens
atccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctga

SEQ ID NO: 2614 - DNA, 343 bp, Homo sapiens
gacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggct

SEQ ID NO: 2615 - DNA, 500 bp, Homo sapiens
aaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggt

SEQ ID NO: 2616 - DNA, 220 bp, Homo sapiens
gatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtga

SEQ ID NO: 2617 - DNA, 36 bp, Homo sapiens
ctgcagcatctcttccagcctcagccgcacactgaa

SEQ ID NO: 2618 - DNA, 36 bp, Homo sapiens
ttgtgtgccccgctccagcagcctcccgcgacgatg

SEQ ID NO: 2619 - DNA, 36 bp, Homo sapiens
tgagctcatcgaaaagaggtgccgccggatggtggt

SEQ ID NO: 2620 - DNA, 36 bp, Homo sapiens
cactcagcctctctccaggtgcccatcagaagcgac

SEQ ID NO: 2621 - DNA, 74 bp, Homo sapiens
ggttgtctctgatgattacctgcagagcaaggaatgtgacttccagaccaaatttgcactcagcctctctccag

SEQ ID NO: 2622 - DNA, 56 bp, Homo sapiens
ggttgtctctgatgattacctgcagagcaaggaatgtgacttccagaccaaatttg

SEQ ID NO: 2623 - DNA, 36 bp, Homo sapiens; identical to SEQ ID NO: 2620

SEQ ID NO: 2624 - DNA, 36 bp, Homo sapiens
aaggtcaccaagctgcaggtggagctggacaacgtg

SEQ ID NO: 2625 - DNA, 36 bp, Homo sapiens
tactcagggctcatctacacctattcaggcctgttc

SEQ ID NO: 2626 - DNA, 36 bp, Homo sapiens
gccaccctccatgcccaggtggccgacatgaaaaag

SEQ ID NO: 2627 - DNA, 500 bp, Homo sapiens
agctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctg

SEQ ID NO: 2628 - DNA, 316 bp, Homo sapiens
catggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttac

SEQ ID NO: 2629 - DNA, 500 bp, Homo sapiens
caggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcct

SEQ ID NO: 2630 - DNA, 171 bp, Homo sapiens
aaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgac

SEQ ID NO: 2631 - DNA, 53 bp, Homo sapiens
cgtgccaagcgccaggcccagcaggagcgggatgagctggctgacgagatcgc

SEQ ID NO: 2632 - DNA, 140 bp, Homo sapiens
tctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgg

SEQ ID NO: 2633 - DNA, 36 bp, Homo sapiens
agctggctggagctgcaggtgtcctccctgggcagc

SEQ ID NO: 2634 - DNA, 36 bp, Homo sapiens
gccaagtacacgttccaggatttcaccgagcagttc

SEQ ID NO: 2635 - DNA, 138 bp, Homo sapiens
ggctacaaggatctgatggagaactaccagatcgtcgtcagcaacctggccactgagcgtggccagaaggacaccaacctggtcctcaacctcttccagtcactgctagatgagttcacccgtggctacaccaagaac

SEQ ID NO: 2636 - DNA, 36 bp, Homo sapiens
ctaggactgcaggtgtgcaccaccatgcccagctaa

SEQ ID NO: 2637 - DNA, 36 bp, Homo sapiens
ggctccgggccctaagggtgaaggagaacgacctgc

SEQ ID NO: 2638 - DNA, 259 bp, Homo sapiens
ttcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagca

SEQ ID NO: 2639 - DNA, 25 bp, Homo sapiens
aaaggagatttcttccctcctgagc

SEQ ID NO: 2640 - DNA, 36 bp, Homo sapiens
gctctgaaagctactctggtggagagttctacttca

SEQ ID NO: 2641 - DNA, 36 bp, Homo sapiens
aaagatcatttttaaaaggcaagaaacaaaagaagc

SEQ ID NO: 2642 - DNA, 37 bp, Homo sapiens
ctgtcactgaagatgggttgcattttgtagaatatta

SEQ ID NO: 2643 - DNA, 36 bp, Homo sapiens
gctaagaaactattgggtttaggacagaaacatctg

SEQ ID NO: 2644 - DNA, 36 bp, Homo sapiens
tggaggaaccatccacagatgattgctgtactagtg

SEQ ID NO: 2645 - DNA, 36 bp, Homo sapiens
gaaggaaaggaagacttgtgctgcacagttagtgag

SEQ ID NO: 2646 - DNA, 75 bp, Homo sapiens
tttcaacttccagcaccccctcacattgatgtgatgtacacaacactcctcattgaactgtgcaaacttcaacct

SEQ ID NO: 2647 - DNA, 500 bp, Homo sapiens
aaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtata

SEQ ID NO: 2648 - DNA, 207 bp, Homo sapiens
gggggcttctgaggcgatcgggcagtatcagtcttcagccgctaagccgagaagatctgggaaggagtcagtcagagagccttgggccagagttccaggggctctgggagtggctgccagatctctctctgtcgcccagtctggagtgcaatggcacgatcctggctcactgcaagctccgcctcctgggttcacgccattcttctg

SEQ ID NO: 2649 - DNA, 36 bp, Homo sapiens
aacctctgtcctccttaggttttcgtcatcgaggtg

SEQ ID NO: 2650 - DNA, 248 bp, Homo sapiens
ggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgc

SEQ ID NO: 2651 - DNA, 36 bp, Homo sapiens
gccggggaggctttggagggcgaggaggcttccgag

SEQ ID NO: 2652 - DNA, 36 bp, Homo sapiens
gaaaagacagtaagaaagagcgagatgcgagaacac

SEQ ID NO: 2653 - DNA, 27 bp, Homo sapiens
gaggccgaggaggatttggtggcagag

SEQ ID NO: 2654 - DNA, 36 bp, Homo sapiens
gcagaggcggctttggaggacgaggtggtggtagag

SEQ ID NO: 2655 - DNA, 122 bp, Homo sapiens
taagacagaagctgatgcagagaaaacctttgaagaaaagcagggaacagagatcgatgggcgatctatttccctgtactatactggagagaaaggtcaaaatcaagactatagaggtggaa

SEQ ID NO: 2656 - DNA, 54 bp, Homo sapiens
aagcagctgtcactccaggcaaaaaggcagcagcaacacctgccaagaagacag

SEQ ID NO: 2657 - DNA, 77 bp, Homo sapiens
agcaaagaaggtggtcgtttccccaacaaaaaaggttgcagttgccacaccagccaagaaagcagctgtcactccag

SEQ ID NO: 2658 - DNA, 55 bp, Homo sapiens
ttggccagtctggtctcgaactcctgacttcataatccgcctgcctcggcctccc

SEQ ID NO: 2659 - DNA, 36 bp, Homo sapiens
gattcatccgaaagcagtgtgtggaccactacaacg

SEQ ID NO: 2660 - DNA, 91 bp, Homo sapiens
acaaaaccggccttgtggaatttgcaagaaacctgaccgctcttggtttgaatctggtcgcttccggagggactgcaaaagctctcaggga

SEQ ID NO: 2661 - DNA, 36 bp, Homo sapiens
aattttgtgcccttgcagattgatcacttattcatt

SEQ ID NO: 2662 - DNA, 36 bp, Homo sapiens
aacttattgggaaaacaggtatggcttcaattttta

SEQ ID NO: 2663 - DNA, 114 bp, Homo sapiens
tcaggctctatctgaaaccttcacaagatgttcatagagttttagtggctagaataattcatgctgttaccaaaggatgctgttctcagactgacggattaaattccaaatttt

SEQ ID NO: 2664 - DNA, 298 bp, Homo sapiens
ttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatg

SEQ ID NO: 2665 - DNA, 500 bp, Homo sapiens
tctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttc

SEQ ID NO: 2666 - DNA, 500 bp, Homo sapiens
gaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggag

SEQ ID NO: 2667 - DNA, 499 bp, Homo sapiens
gactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgag

SEQ ID NO: 2668 - DNA, 500 bp, Homo sapiens
tccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttac

SEQ ID NO: 2669 - DNA, 500 bp, Homo sapiens
gaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacct

SEQ ID NO: 2670 - DNA, 500 bp, Homo sapiens
gatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatc

SEQ ID NO: 2671 - DNA, 500 bp, Homo sapiens
agcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgc

SEQ ID NO: 2672 - DNA, 500 bp, Homo sapiens
ggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggt

SEQ ID NO: 2673 - DNA, 500 bp, Homo sapiens
gtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgt

SEQ ID NO: 2674 - DNA, 36 bp, Homo sapiens
gtagcaataactggaccagcagtgccctactccagg

SEQ ID NO: 2675 - DNA, 36 bp, Homo sapiens
tttgacgaaaaccgattgacaagagatgatttccta

SEQ ID NO: 2676 - DNA, 500 bp, Homo sapiens
ctcagcctccagacctgggacttgccatcattccagaacccactacagagactagacattttacagccctggagaagactacagctcctcgtccagaccgggttcagactttgcatcgaagcctgactgaagtcacaggtccacctactgaactagaacctgctcaggattcactggtgcagtttgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctg

SEQ ID NO: 2677 - DNA, 36 bp, Homo sapiens
tgactggagtagaggaaggtcgtctgatctttgata

SEQ ID NO: 2678 - DNA, 36 bp, Homo sapiens
tggcctatgggcagattggaatgatccaggccctgg

SEQ ID NO: 2679 - DNA, 36 bp, Homo sapiens
agctacgggcagcagtggacctatgagcagaggaaa

SEQ ID NO: 2680 - DNA, 36 bp, Homo sapiens
cttccagcaggggatgaagaacaagatcttgatatt

SEQ ID NO: 2681 - DNA, 500 bp, Homo sapiens
tcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggc

SEQ ID NO: 2682 - DNA, 500 bp, Homo sapiens
atcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctat

SEQ ID NO: 2683 - DNA, 36 bp, Homo sapiens
gagaccgaattcctgctgacctcagaatcatatctg

SEQ ID NO: 2684 - DNA, 427 bp, Homo sapiens
ccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctct

SEQ ID NO: 2685 - DNA, 500 bp, Homo sapiens
agtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgaca

SEQ ID NO: 2686 - DNA, 500 bp, Homo sapiens
actggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaat

SEQ ID NO: 2687 - DNA, 133 bp, Homo sapiens
actggtgacggtgtgaatgactctccagctttgaagaaagcagacattggggttgctatggggattgctggctcagatgtgtccaagcaagctgctgacatgattcttctggatgacaactttgcctcaattg

SEQ ID NO: 2688 - DNA, 500 bp, Homo sapiens
acttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgt

SEQ ID NO: 2689 - DNA, 500 bp, Homo sapiens
gcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggtt

SEQ ID NO: 2690 - DNA, 500 bp, Homo sapiens
ttgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcatt

SEQ ID NO: 2691 - DNA, 500 bp, Homo sapiens
gaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgcc

SEQ ID NO: 2692 - DNA, 110 bp, Homo sapiens
gaggcttctttacttactttgtgattctggctgagaacggcttcctcccaattcacctgttgggcctccgagtggactgggatgaccgctggatcaacgatgtggaagac

SEQ ID NO: 2693 - DNA, 500 bp, Homo sapiens
cactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagca

SEQ ID NO: 2694 - DNA, 95 bp, Homo sapiens
atcgtggagttcacctgccacacagccttcttcgtcagtatcgtggtggtgcagtgggccgacttggtcatctgtaagaccaggaggaattcggt

SEQ ID NO: 2695 - DNA, 500 bp, Homo sapiens
tataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggt

SEQ ID NO: 2696 - DNA, 36 bp, Homo sapiens
tggcctacgggcagattggaatgatccaggctctcg

SEQ ID NO: 2697 - DNA, 36 bp, Homo sapiens
ttgctggagtcagaccagggagcccccgggccacag

SEQ ID NO: 2698 - DNA, 500 bp, Homo sapiens
cagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcag

SEQ ID NO: 2699 - DNA, 500 bp, Homo sapiens
gatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatcc

SEQ ID NO: 2700 - DNA, 36 bp, Homo sapiens
aagcccccatccaaggtgaagtccagtagcaaggag

SEQ ID NO: 2701 - DNA, 500 bp, Homo sapiens
cgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaaccc

SEQ ID NO: 2702 - DNA, 500 bp, Homo sapiens
ggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccat

SEQ ID NO: 2703 - DNA, 36 bp, Homo sapiens
agctacggacagcagtggacctatgagcaacgaaaa

SEQ ID NO: 2704 - DNA, 36 bp, Homo sapiens
ctggatgaagatgtgaagatgatcagtgcagaagcg

SEQ ID NO: 2705 - DNA, 500 bp, Homo sapiens
aacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagc

SEQ ID NO: 2706 - DNA, 36 bp, Homo sapiens
gagttacaaaagtcacaggacgtccagcaggagcag

SEQ ID NO: 2707 - DNA, 36 bp, Homo sapiens
tggttcccagtttttcatgtgagtaggcataattca

SEQ ID NO: 2708 - DNA, 298 bp, Homo sapiens
aagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaac

SEQ ID NO: 2709 - DNA, 36 bp, Homo sapiens
ctcaaagccttgcgtgacctgacccaggtgcaagag

SEQ ID NO: 2710 - DNA, 178 bp, Homo sapiens
ctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctga

SEQ ID NO: 2711 - DNA, 500 bp, Homo sapiens
gtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgt

SEQ ID NO: 2712 - DNA, 110 bp, Homo sapiens
agatcaagatcctgttctgagtcagatgatgatgacagcagtgaaactcctcctcactggaaagaggaaatgcagagattaagagcatatagaccacctagtggagaaaa

SEQ ID NO: 2713 - DNA, 293 bp, Homo sapiens
attggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattg

SEQ ID NO: 2714 - DNA, 36 bp, Homo sapiens
tagtgcgccacggctcggcgtcccctccagaggagg

SEQ ID NO: 2715 - DNA, 36 bp, Homo sapiens
gtcagatggctatgggaggtgctatgggcataaaca

SEQ ID NO: 2716 - DNA, 36 bp, Homo sapiens
gataccagtcggtagaggagaagtcgaggttagagg

SEQ ID NO: 2717 - DNA, 36 bp, Homo sapiens
tctgcaatcgaagttgagggtgcaaaaatgcagagt

SEQ ID NO: 2718 - DNA, 36 bp, Homo sapiens
ggaaccttccctgatgcgagagagcaggagattcgg

SEQ ID NO: 2719 - DNA, 118 bp, Homo sapiens
cagtctctcagaacacagtgcaatcaaattagaactcaggattaagaaactcactcaaaaccgcacaactacatggaaattgaacaacctgttcctgaatgactactgggtaaataac

SEQ ID NO: 2720 - DNA, 425 bp, Homo sapiens
ggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtctt

SEQ ID NO: 2721 - DNA, 25 bp, Homo sapiens
gggaactgggaggcactttgctgtc

SEQ ID NO: 2722 - DNA, 48 bp, Homo sapiens
gctcttttctcgggacgggagaggccgtgtagcgtcgccgttactccg

SEQ ID NO: 2723 - DNA, 82 bp, Homo sapiens
acagaggtgccatgccccctgctcctgtgccagctggtaccccagctcctccaggacctgccactatgatgccggatggaac

SEQ ID NO: 2724 - DNA, 361 bp, Homo sapiens
aatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacact

SEQ ID NO: 2725 - DNA, 36 bp, Homo sapiens
cccccagccccagagaaactgccacatacaccacaa

SEQ ID NO: 2726 - DNA, 500 bp, Homo sapiens
aaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtg

SEQ ID NO: 2727 - DNA, 49 bp, Homo sapiens
aaaccaaacatcccccaatgaccttagccccattgctccattcactccc

SEQ ID NO: 2728 - DNA, 446 bp, Homo sapiens
ttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactc

SEQ ID NO: 2729 - DNA, 36 bp, Homo sapiens
attctctccatccctcagctccacaatgcagccaac

SEQ ID NO: 2730 - DNA, 36 bp, Homo sapiens
acaaaagaggaaatgcaggcgggtaaacaccaagaa

SEQ ID NO: 2731 - DNA, 36 bp, Homo sapiens
atggcaaggacttgattgtgtcattaagcaaaagaa

SEQ ID NO: 2732 - DNA, 36 bp, Homo sapiens
acccagccatcatcacaggtattccagcgtcttcag

SEQ ID NO: 2733 - DNA, 500 bp, Homo sapiens
gggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaa

SEQ ID NO: 2734 - DNA, 123 bp, Homo sapiens
aaaagacaggagaaaagcaaacagaaacctggttataacctgacgctaaaactaaaaacaaggaaatgtacctctttcttcagaattaaaactaaaatcttaaataaaacagaaaacttgatg

SEQ ID NO: 2735 - DNA, 495 bp, Homo sapiens
gcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcag

SEQ ID NO: 2736 - DNA, 162 bp, Homo sapiens
gcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcag

SEQ ID NO: 2737 - DNA, 463 bp, Homo sapiens
cggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctt

SEQ ID NO: 2738 - DNA, 446 bp, Homo sapiens
tttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagag

SEQ ID NO: 2739 - DNA, 500 bp, Homo sapiens
tgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcaca

SEQ ID NO: 2740 - DNA, 500 bp, Homo sapiens
tatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttt

SEQ ID NO: 2741 - DNA, 500 bp, Homo sapiens
agattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgcca

SEQ ID NO: 2742 - DNA, 500 bp, Homo sapiens
ccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaa

SEQ ID NO: 2743 - DNA, 214 bp, Homo sapiens
ccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccac

SEQ ID NO: 2744 - DNA, 500 bp, Homo sapiens
cctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcagga

SEQ ID NO: 2745 - DNA, 500 bp, Homo sapiens
gaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccac

SEQ ID NO: 2746 - DNA, 36 bp, Homo sapiens
gcccaaggtgtcttccagattctgattcgcaaccga

SEQ ID NO: 2747 - DNA, 36 bp, Homo sapiens
gacatgcaggacaacaaggaagagacacctctgttt

SEQ ID NO: 2748 - DNA, 36 bp, Homo sapiens
tggatgaatgtgccatggccaatagcaatccttgtg

SEQ ID NO: 2749 - DNA, 36 bp, Homo sapiens
catgtctgtgcatgccaggtttcaaaggtgtgcatt

SEQ ID NO: 2750 - DNA, 500 bp, Homo sapiens
tgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcacc

SEQ ID NO: 2751 - DNA, 461 bp, Homo sapiens
gctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaat

SEQ ID NO: 2752 - DNA, 224 bp, Homo sapiens
gggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacct

SEQ ID NO: 2753 - DNA, 500 bp, Homo sapiens
ggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacct

SEQ ID NO: 2754 - DNA, 500 bp, Homo sapiens
atgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctg

SEQ ID NO: 2755 - DNA, 500 bp, Homo sapiens
agcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatc

SEQ ID NO: 2756 - DNA, 153 bp, Homo sapiens
agcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttca

SEQ ID NO: 2757 - DNA, 97 bp, Homo sapiens
ggtgtcaactgtgagtatgaagtggatgagtgccagaatcagccctgccagaatggaggcacctgtattgaccttgtgaaccatttcaagtgctctt

SEQ ID NO: 2758 - DNA, 500 bp, Homo sapiens
tcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccactt

SEQ ID NO: 2759 - DNA, 500 bp, Homo sapiens
ctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggcc

SEQ ID NO: 2760 - DNA, 202 bp, Homo sapiens
tgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaa

SEQ ID NO: 2761 - DNA, 500 bp, Homo sapiens
gtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaac

SEQ ID NO: 2762 - DNA, 500 bp, Homo sapiens
tggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctcc

SEQ ID NO: 2763 - DNA, 176 bp, Homo sapiens
ccaggctggagtccagtggtgcaatctcggctccctgcaacctctgcctcctgggttcaagcgattctcctgcctcagcctcctgagtagctgggattacaggcatgcaccaccatgcccagctaattttgtatttttaatagaaatggggtttcaccatgttggtcaggctgatc

SEQ ID NO: 2764 - DNA, 36 bp, Homo sapiens
ccaagcaccaacaccatggtaaggaaacagaccctt

SEQ ID NO: 2765 - DNA, 500 bp, Homo sapiens
catctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttct

SEQ ID NO: 2766 - DNA, 500 bp, Homo sapiens
gaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatt

SEQ ID NO: 2767 - DNA, 36 bp, Homo sapiens
gatgttggttttgccatgggcatcgcaggcacagat

SEQ ID NO: 2768 - DNA, 144 bp, Homo sapiens
aaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatc

SEQ ID NO: 2769 - DNA, 36 bp, Homo sapiens
gaactcagcaggagggagtttgtgtttgaaaatgtg

SEQ ID NO: 2770 - DNA, 36 bp, Homo sapiens
atcaacccagcgttggacaaatactttccgtcagac

SEQ ID NO: 2771 - DNA, 87 bp, Homo sapiens
tctggagtgagaatcatagctgagcccggcagatactatgttgcatcagctttcacgcttgcagttaatatcattgccaagaaaatt

SEQ ID NO: 2772 - DNA, 127 bp, Homo sapiens
ccagcgttggacaaatactttccgtcagactctggagtgagaatcatagctgagcccggcagatactatgttgcatcagctttcacgcttgcagttaatatcattgccaagaaaattgtattaaagg

SEQ ID NO: 2773 - DNA, 505 bp, Homo sapiens
atacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcg

SEQ ID NO: 2774 - DNA, 500 bp, Homo sapiens
agactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgaccca

SEQ ID NO: 2775 - DNA, 104 bp, Homo sapiens
agatggggtttcaccatgttggccaggatggtctctatctcttgacctcgtgatctgcctgcctcggcctcccaaagtgctgggattacagacctgagccaccg

SEQ ID NO: 2776 - DNA, 81 bp, Homo sapiens
ggctggagtgcaatggcgcaatctcagctcactgcgacttccgcctcccaggttcaagcaattctcctgcctcagcctccc

SEQ ID NO: 2777 - DNA, 36 bp, Homo sapiens
accagggctatgaagcaggtagcaggtaccatgaag

SEQ ID NO: 2778 - DNA, 500 bp, Homo sapiens
ctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacc

SEQ ID NO: 2779 - DNA, 26 bp, Homo sapiens
tccatgcctctaacactcatcttcaa

SEQ ID NO: 2780 - DNA, 37 bp, Homo sapiens
gtctacgccgcacttactagatgaagatataaattac

SEQ ID NO: 2781 - DNA, 61 bp, Homo sapiens
ggttcatctttcattgctgcaaggaacttccatgcctctaacactcatcttcaaaagactg

SEQ ID NO: 2782 - DNA, 36 bp, Homo sapiens
caaaggaccgatcggcggcttcgggctgccggctca

SEQ ID NO: 2783 - DNA, 36 bp, Homo sapiens
gcgtgtggtgtcctccagccctgcccttctccgaga

SEQ ID NO: 2784 - DNA, 500 bp, Homo sapiens
ttaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttcta

SEQ ID NO: 2785 - DNA, 512 bp, Homo sapiens
atgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaa

SEQ ID NO: 2786 - DNA, 54 bp, Homo sapiens
aagcaaggaagaagtctctatcacttctactcccaaggcccgtccacatgtctg

SEQ ID NO: 2787 - DNA, 36 bp, Homo sapiens
ggggcaggggatgatgacgatctcgaggacctggaa

SEQ ID NO: 2788 - DNA, 36 bp, Homo sapiens
cgtggctcctccctgcaggactttgtgttgctgaaa

SEQ ID NO: 2789 - DNA, 36 bp, Homo sapiens
agcggaaccgcgtgggaggactttgtgttgctgaaa

SEQ ID NO: 2790 - DNA, 36 bp, Homo sapiens
tttaccgaagtgactgagtgcgaggttaaaaccttc

SEQ ID NO: 2791 - DNA, 36 bp, Homo sapiens
agaagatgaggctgcaaggaaagcaaagcaaggaaa

SEQ ID NO: 2792 - DNA, 36 bp, Homo sapiens
aagctgaggagaaaaaacgtgagacagctagtgttt

SEQ ID NO: 2793 - DNA, 500 bp, Homo sapiens
ctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattct

SEQ ID NO: 2794 - DNA, 500 bp, Homo sapiens
ttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgattta

SEQ ID NO: 2795 - DNA, 521 bp, Homo sapiens
agaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctg

SEQ ID NO: 2796 - DNA, 36 bp, Homo sapiens
tctaccccgacctcgctggcaagccctccctgccct

SEQ ID NO: 2797 - DNA, 36 bp, Homo sapiens
gctaaagaaaagtgacgggatccggaaagtatggca

SEQ ID NO: 2798 - DNA, 36 bp, Homo sapiens
ttttgattgcttccacagtggcactaaggaaaacag

SEQ ID NO: 2799 - DNA, 36 bp, Homo sapiens
acactgctgaaaaatctgctccagggtttgagccac

SEQ ID NO: 2800 - DNA, 500 bp, Homo sapiens
cctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtg

SEQ ID NO: 2801 - DNA, 384 bp, Homo sapiens
gaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctg

SEQ ID NO: 2802 - DNA, 310 bp, Homo sapiens
ggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggg

SEQ ID NO: 2803 - DNA, 310 bp, Homo sapiens
gacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaaca

SEQ ID NO: 2804 - DNA, 500 bp, Homo sapiens
atcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaag

SEQ ID NO: 2805 - DNA, 500 bp, Homo sapiens
acagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtgga

SEQ ID NO: 2806 - DNA, 403 bp, Homo sapiens
tgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaagga

SEQ ID NO: 2807 - DNA, 500 bp, Homo sapiens
gacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaa

SEQ ID NO: 2808 - DNA, 500 bp, Homo sapiens
ccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacct

SEQ ID NO: 2809 - DNA, 500 bp, Homo sapiens
gacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccggga

SEQ ID NO: 2810 - DNA, 500 bp, Homo sapiens
caacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccaccc

SEQ ID NO: 2811 - DNA, 36 bp, Homo sapiens
gctcactgcaacctcctcctccagaggtacttctca

SEQ ID NO: 2812 - DNA, 36 bp, Homo sapiens
gctcactgcaacctcctcctcccaggtacaagcgat

SEQ ID NO: 2813 - DNA, 36 bp, Homo sapiens
tcctgacctcttgatccgcctgccttggcctcccaa

SEQ ID NO: 2814 - DNA, 36 bp, Homo sapiens
ccagaggctgaggcaggcgcggatcacctgaggtca

SEQ ID NO: 2815 - DNA, 128 bp, Homo sapiens
ggagttcaagatcagcctgaccaacatggagaaaccctactaaaaatacaaagttagccaggcatagtggtgcatgcctgtaatcccagctgctcaggagcctggcaacaagagcaaaactccagctc

SEQ ID NO: 2816 - DNA, 36 bp, Homo sapiens
gccattccacagccagatttgaccaagctgcaccag

SEQ ID NO: 2817 - DNA, 36 bp, Homo sapiens
aggtgaaaggctattgggcaggtttggatgcatctg

SEQ ID NO: 2818 - DNA, 36 bp, Homo sapiens
ctcaccattccaaacgatttgattggctgcataatc

SEQ ID NO: 2819 - DNA, 36 bp, Homo sapiens
aagaagatgcgcgaggagagtggtgcacgtatcaac

SEQ ID NO: 2820 - DNA, 36 bp, Homo sapiens
attgacaaactggaagaggacataagcagctctatg

SEQ ID NO: 2821 - DNA, 32 bp, Homo sapiens
ggaaagaaaggagaatcagttaagaagatgcg

SEQ ID NO: 2822 - DNA, 99 bp, Homo sapiens
agcgacagtgcgagctttccccacaccaccccgtccatgtgcctcaaccctgacctggagggaccacctctagaggcctataccattcaaggacagtat

SEQ ID NO: 2823 - DNA, 57 bp, Homo sapiens
agcgacagtgcgagctttccccacaccaccccgtccatgtgcctcaaccctgacctg

SEQ ID NO: 2824 - DNA, 25 bp, Homo sapiens
acagtatgccattccacagccagat

SEQ ID NO: 2825 - DNA, 36 bp, Homo sapiens
ctcagactacttctcatgaactcaccattccaaacg

SEQ ID NO: 2826 - DNA, 149 bp, Homo sapiens
tcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacct

SEQ ID NO: 2827 - DNA, 42 bp, Homo sapiens
ttggcaatgcaacagtctcattttcccatgacgcatggcaac

SEQ ID NO: 2828 - DNA, 59 bp, Homo sapiens
tgctcaggctggtctccaactcctgagcttccgatgattcgactgccttggtctcccaa

SEQ ID NO: 2829 - DNA, 348 bp, Homo sapiens
ggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaag

SEQ ID NO: 2830 - DNA, 500 bp, Homo sapiens
caggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacga

SEQ ID NO: 2831 - DNA, 151 bp, Homo sapiens
tgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctca

SEQ ID NO: 2832 - DNA, 25 bp, Homo sapiens
gagaatcagttaagaagatgcgcga

SEQ ID NO: 2833 - DNA, 448 bp, Homo sapiens
cagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagtt

SEQ ID NO: 2834 - DNA, 500 bp, Homo sapiens
ccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatc

SEQ ID NO: 2835 - DNA, 51 bp, Homo sapiens
actgcaacttctgcttcccagcttcaagcaattctcctgcctcagcctcca

SEQ ID NO: 2836 - DNA, 303 bp, Homo sapiens
ttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaa

SEQ ID NO: 2837 - DNA, 321 bp, Homo sapiens
gtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaa

SEQ ID NO: 2838 - DNA, 53 bp, Homo sapiens
gatctcagctcactgcgacctccacctcctgggttcaggcgattctcctgcct

SEQ ID NO: 2839 - DNA, 36 bp, Homo sapiens
ttcagtgatttagatcagagaagcattggaagtgat

SEQ ID NO: 2840 - DNA, 36 bp, Homo sapiens
gcaatggagagcagccagattgtaagcaggcttgtt

SEQ ID NO: 2841 - DNA, 336 bp, Homo sapiens
gagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccag

SEQ ID NO: 2842 - DNA, 500 bp, Homo sapiens
caaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggt

SEQ ID NO: 2843 - DNA, 38 bp, Homo sapiens
aatcaggacatctgctactacaacttcctctgcgccca

SEQ ID NO: 2844 - DNA, 500 bp, Homo sapiens
tcttttcctggcagttccccttatgagggttacaactatggctcctttgagaatgtttctggatctaccgatggtctggttgacagcgctggcactggggacctctcttacggttaccaggggcacgaccagttcaagcggcgcctcccctctggccagatgcggcagctgtgcattgccatgggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgccca

SEQ ID NO: 2845 - DNA, 36 bp, Homo sapiens
ttcttccacacatgcaaggtgaaagggtgtggattt

SEQ ID NO: 2846 - DNA, 50 bp, Homo sapiens
atatgctgaagaagccccttatgatgccattcatgtgggagctgcagccc

SEQ ID NO: 2847 - DNA, 66 bp, Homo sapiens
cagttgctggtacagtgctgcacctggctgagtgaatggtttcttttggagctgataaagctgcct

SEQ ID NO: 2848 - DNA, 325 bp, Homo sapiens
aatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactaga

SEQ ID NO: 2849 - DNA, 118 bp, Homo sapiens
agagttaccttgatcaaggaacacagatcttcttaaacaacagcattgagaaatcgggctggctatttatccaattatatcattcttttgtgtcatctgtttttagcctgtttatgtc

SEQ ID NO: 2850 - DNA, 36 bp, Homo sapiens
aagactgtctgcagcaagcctggcaccttactgcag

SEQ ID NO: 2851 - DNA, 116 bp, Homo sapiens
tgttttttcgagacagagccttgctctgtcacccaggctggagtgcagtggtatgatctcagctcaaggcaacctccgcctcccaggttcaagcgattctcccgccttagcctcct

SEQ ID NO: 2852 - DNA, 73 bp, Homo sapiens
ctcccaggttcaagccattctcctgcctcagcctcctgagtagctgggattacaggcgcccaccaccacgccc

SEQ ID NO: 2853 - DNA, 36 bp, Homo sapiens
ccccctctccctgcccaggcctcctcagcgccttac

SEQ ID NO: 2854 - DNA, 36 bp, Homo sapiens
gcctacatctgaaacatggtggaaaacgaagctcat

SEQ ID NO: 2855 - DNA, 36 bp, Homo sapiens
cgacacttccatgtccaggttttcccatcatatgat

SEQ ID NO: 2856 - DNA, 36 bp, Homo sapiens
cagtgacctaatgcacgtgaagcctcagcatgaaca

SEQ ID NO: 2857 - DNA, 48 bp, Homo sapiens
tcccatcacgggtggattcaggcaaccctacccatcctcactgtcagt

SEQ ID NO: 2858 - DNA, 425 bp, Homo sapiens
gttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaac

SEQ ID NO: 2859 - DNA, 221 bp, Homo sapiens
tcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataa

SEQ ID NO: 2860 - DNA, 189 bp, Homo sapiens
gcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactga

SEQ ID NO: 2861 - DNA, 500 bp, Homo sapiens
gaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccccca

SEQ ID NO: 2862 - DNA, 115 bp, Homo sapiens
gtgcagccatcccatgcggtccatcctctcacccccctcatcacttacagtgacgagcacttttctccaggatcacacccgtcacacatcccatcagatgtcaactccaaacaag

SEQ ID NO: 2863 - DNA, 500 bp, Homo sapiens
gcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacct

SEQ ID NO: 2864 - DNA, 500 bp, Homo sapiens
gtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaa

SEQ ID NO: 2865 - DNA, 500 bp, Homo sapiens
cagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaa

SEQ ID NO: 2866 - DNA, 500 bp, Homo sapiens
tcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaat

SEQ ID NO: 2867 - DNA, 87 bp, Homo sapiens
tcccggtcctcctggtccccacacaactggcatccctcatccagctattgtaacacctcaggtcaaacaggaacatccccacactga

SEQ ID NO: 2868 - DNA, 127 bp, Homo sapiens
gagaaaggagcaggagccaaaaagacctcacattaagaagcctctgaatgcttttatgttatacatgaaagaaatgagagcgaatgtcgttgctgagtgtactctaaaagaaagtgcagctatcaac

SEQ ID NO: 2869 - DNA, 197 bp, Homo sapiens
gggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccac

SEQ ID NO: 2870 - DNA, 179 bp, Homo sapiens
agaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccac

SEQ ID NO: 2871 - DNA, 500 bp, Homo sapiens
ctgttacccaggctggaggacagtgatgtgatctcgggtcaccacaacctccgcctcccggattcaggcgattctcatgcctcagcctcccgagtagctcagattacaggcatgtgccaccacgcccggctaattttgtattttcagtcgagacggggtttccccatgttggtcaggctggtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaa

SEQ ID NO: 2872 - DNA, 88 bp, Homo sapiens
ttgcccaggctggaatgcagtggcacaatcataactcactgcagcctcgaactgctgggctcaagaaatcctcctgtctcagcctcct

SEQ ID NO: 2873 - DNA, 26 bp, Homo sapiens
tcttctgcctcagcctcccgagtagc

SEQ ID NO: 2874 - DNA, 60 bp, Homo sapiens
gatcttggttcactgcaacctccacctcccgggttcaagcaactttcctgcctcagcctc

SEQ ID NO: 2875 - DNA, 286 bp, Homo sapiens
gaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaa

SEQ ID NO: 2876 - DNA, 391 bp, Homo sapiens
gttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgcc

SEQ ID NO: 2877 - DNA, 177 bp, Homo sapiens
catccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcct

SEQ ID NO: 2878 - DNA, 36 bp, Homo sapiens
tggcttcctctgatgctgacaaggtggggaacaatc

SEQ ID NO: 2879 - DNA, 36 bp, Homo sapiens
catgccccttatcctcagcctccaagtgtgccgccc

SEQ ID NO: 2880 - DNA, 392 bp, Homo sapiens
gccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctg

SEQ ID NO: 2881 - DNA, 195 bp, Homo sapiens
cggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcct

SEQ ID NO: 2882 - DNA, 36 bp, Homo sapiens
tgtgctgtgtgtgtcctgcctgtatatgtggcttcc

SEQ ID NO: 2883 - DNA, 126 bp, Homo sapiens
gttcggagcgaccttggccgttggcctgaccatctttgtgctgtctgtcgtcactatcatcatctgcttcacctgctcctgctgctgcctttacaagacgtgccgccgaccacgtccggttgtcac

SEQ ID NO: 2884 - DNA, 500 bp, Homo sapiens
cgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacgg

SEQ ID NO: 2885 - DNA, 80 bp, Homo sapiens
cgttggcctgaccatctttgtgctgtctgtcgtcactatcatcatctgcttcacctgctcctgctgctgcctttacaaga

SEQ ID NO: 2886 - DNA, 235 bp, Homo sapiens
tgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctccc

SEQ ID NO: 2887 - DNA, 36 bp, Homo sapiens
cacctcagcctcccaaaatgctgggattacaggcat

SEQ ID NO: 2888 - DNA, 36 bp, Homo sapiens
tcccacctcagcctcccaaaatgctgggattacagg

SEQ ID NO: 2889 - DNA, 350 bp, Homo sapiens
gatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtcccc

SEQ ID NO: 2890 - DNA, 247 bp, Homo sapiens
cggcccagggcaatccgaccacatttcactctcaccgctgtaggaatccagatgcaggccaagtacagcagcacgagggacatgctggatgatgatggggacaccaccatgagcctgcattctcaaggctctgccacaactcggcatccagagccccggcgcacagagcacagggctccctcttcaacgtggcgaccagtggccctgaccctgctgactttgtgcttggtgctgctgatagggctgg

SEQ ID NO: 2891 - DNA, 80 bp, Homo sapiens
gctggagtgcagtggcttaatcatggctcacggcaacctttgcctcctgggctcaagccatcctcccacctcagcctccc

SEQ ID NO: 2892 - DNA, 36 bp, Homo sapiens
atggaccctgtctcagtgtcatacccatctaattac

SEQ ID NO: 2893 - DNA, 451 bp, Homo sapiens
atggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaatt

SEQ ID NO: 2894 - DNA, 500 bp, Homo sapiens
caagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaatt

SEQ ID NO: 2895 - DNA, 500 bp, Homo sapiens
gagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtccccccc

SEQ ID NO: 2896 - DNA, 36 bp, Homo sapiens
gctactcgggaggctgaggcaggagaatcacttgaa

SEQ ID NO: 2897 - DNA, 500 bp, Homo sapiens
tgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgt

SEQ ID NO: 2898 - DNA, 500 bp, Homo sapiens
cctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcg

SEQ ID NO: 2899 - DNA, 230 bp, Homo sapiens
cctcaacctgccaagtagctaggattacaggcatgcgctaccacactcagctaatttttgtatttttagtagaggcagagtttcaccatgttggccaggctggtctcgaactcctgaccacaagtgatccgcccaccttggcctcccaaagtgctgggattacaggcgtgagccaccgcacccagcctgtactcattttttataattgcttttacatatacaagcaagca

SEQ ID NO: 2900 - DNA, 36 bp, Homo sapiens
ctgatgggtgctggtggcctttcccccgtggattgg

SEQ ID NO: 2901 - DNA, 36 bp, Homo sapiens
ggcagatgtggcccgcaggtgagccccagcacatga

SEQ ID NO: 2902 - DNA, 83 bp, Homo sapiens
caggctggagtgcaatggctcaatctcggctcaccgcaacctcagcctcccgggttcaagcgattctcctgcctcagcctccc

SEQ ID NO: 2903 - DNA, 36 bp, Homo sapiens
ctccacaggttggcaatgatgctgtcttcctgattt

SEQ ID NO: 2904 - DNA, 193 bp, Homo sapiens
gagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatcca

SEQ ID NO: 2905 - DNA, 386 bp, Homo sapiens
ctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattg

SEQ ID NO: 2906 - DNA, 56 bp, Homo sapiens
ctacaggccagtcgtgtctccagtgatgtcattgaccagaaggtgtatgagatcca

SEQ ID NO: 2907 - DNA, 175 bp, Homo sapiens
ttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatcca

SEQ ID NO: 2908 - DNA, 255 bp, Homo sapiens
catcacggctcaccacaacctctgccttccgggttcaggcgattcttttgtctcagcctccggagtagctgggattacaggcacctgccaccatgcctggctaatttttgtatttttagtagagacagggtttcaccatattggccaggctagtctcaaagtcctgacctcagctgatccgcccacctcagccttccatgatatatgttgttcttcaagcagtttcccctggcttaagtggggagaaagcctcag

SEQ ID NO: 2909 - DNA, 36 bp, Homo sapiens
aattgctgctcttggctggtgttgatagattggata

SEQ ID NO: 2910 - DNA, 157 bp, Homo sapiens
cccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgct

SEQ ID NO: 2911 - DNA, 112 bp, Homo sapiens
tagcacaaaggagaagtgtgacagttacaaagatgatcttctgcttaggatgggacttaatgataataaagcaggaatggaaggattagataaagagaaaattaacaaaatt

SEQ ID NO: 2912 - DNA, 117 bp, Homo sapiens
gaattagaacaaagccgaaatttgagcaataccatagtgcacattgacatggatgctttctatgcagctgtagaaatgagggacaatccagaattgaaggataaacccattgctgta

SEQ ID NO: 2913 - DNA, 353 bp, Homo sapiens
gcctccctacttccatccaatctgacagtggtccagccttcattagccaaatcacccaggcagtttcccaggcccttggcatccagtggaatctccacaccccataccatcctcattcctcaggaaaggttgaaagagccaacggcctcttaaaaactcaccctccaactccgaaaggactggactgttctcctaccacttgtgcttctcaggatctgagccaccgcccatgaacctaccaggtatagcccattcgaactcttatatggtagtacttttctactggggcccaacctcatcccagacaccagtcctccaacaggctaggaatgaaatctgtcaggctgctaacc

SEQ ID NO: 2914 - DNA, 500 bp, Homo sapiens
atggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaa

SEQ ID NO: 2915 - DNA, 100 bp, Homo sapiens
ccaggtagcgtggaatcgcttagaagctgatatcccgaggggcggtgggggtggacagctccggccaccagtgcccgggaaggagggcgcggggctgcgc

SEQ ID NO: 2916 - DNA, 82 bp, Homo sapiens
aggctggagtgcaatggcacgatctcggctcactgccacctccgcctcccgggttcaagcaattctcctgcctcaacctcct

SEQ ID NO: 2917 - DNA, 200 bp, Homo sapiens
ttgtccaggctggtctcaagctcctgggctcaagcaatacttccacctcagcctcccaaaatgctgggattacagatggagtcttgctctgtcgcccaggctggagtgcagtgatgcgatctcggctcactgcaacctccacctcccctggttcaagtgattctcctgcctcagcctcccaagtagctgggactacaagc

SEQ ID NO: 2918 - DNA, 36 bp, Homo sapiens
gtcctcgattctgtccagaaccccgtctgtggcaaa

SEQ ID NO: 2919 - DNA, 36 bp, Homo sapiens
gtcctcgattctgtccaggtgagctgccccaggaag

SEQ ID NO: 2920 - DNA, 36 bp, Homo sapiens
gatggacatccagagaagacaagtgatggagcagca

SEQ ID NO: 2921 - DNA, 36 bp, Homo sapiens
agccacctaactcctcagaggctggccggaagccct

SEQ ID NO: 2922 - DNA, 500 bp, Homo sapiens
atcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaa

SEQ ID NO: 2923 - DNA, 87 bp, Homo sapiens
actcctgggtttttttagattctgcctgacacggaacaccaggtctgctcgtcttttttgtgttttatatttgcttatttaaggtac

SEQ ID NO: 2924 - DNA, 133 bp, Homo sapiens
agcccgggcttccgtgatggtctacgatgacaccagtaagaaatgggtaccaatcaaacctggccagcagggattcagccggatcaacatctaccacaacactgccagcaacaccttcagagtcgttggagtc

SEQ ID NO: 2925 - DNA, 36 bp, Homo sapiens
tttaaagcaaaagaggatgtatgagcagcagcggga

SEQ ID NO: 2926 - DNA, 36 bp, Homo sapiens
tacctgcgccgcctgcaggtgagtgcgccccttccc

SEQ ID NO: 2927 - DNA, 171 bp, Homo sapiens
ccggcactcggtgaagacaggtggtgaggcctagacacaccgagagccgggccccgcgggggcttccaagtgtcggatcagcaagatcatcctttcgaggtcgccgtccttgcaattagtagatgggacccactgccccagggcggtaggggcgcacccgctacgagcgga

SEQ ID NO: 2928 - DNA, 36 bp, Homo sapiens
cgtcccagctgcgaggagtgtaaacaggaacatcga

SEQ ID NO: 2929 - DNA, 403 bp, Homo sapiens
tacgctttctggtggtctgggagtttcgaaatctttaatgttgtgatgacaacgcttacccgcgcatcccttcttgatcgttcttaggtcttctcaggggcctggaagtgtagacctaggcttgggattcaaggaggtcttggttaaaacggcaagatgtaaataagattgtgacgcatccattttgttgaaagaaaaaaccaggaatttggccttttgatggaggaacttagaagaactttgtaatttttgtaaggttgtggaaaatccgaggcaaagttaaattgcctggtgtgatttgactttaacttcgaataggctttttaaagtttcatctctttggagattgttcaacttcacgagttcactgcagtgaaaacgccaagactgtctcccacaaatt

SEQ ID NO: 2930 - DNA, 36 bp, Homo sapiens
tctttttgtctgttttaggatggctacaatagacta

SEQ ID NO: 2931 - DNA, 500 bp, Homo sapiens
aagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaata

SEQ ID NO: 2932 - DNA, 80 bp, Homo sapiens
ccgtgctggagtgcagtggcgcgatcttggcttactacagcctcctggcttcaagcgattctcctgcctcagcctcccaa

SEQ ID NO: 2933 - DNA, 36 bp, Homo sapiens
acgcctcccctgcccacgagcctgccctcgcaaaac

SEQ ID NO: 2934 - DNA, 36 bp, Homo sapiens
accctggtatctgcggctgtatgtgcacaccctcac

SEQ ID NO: 2935 - DNA, 500 bp, Homo sapiens
atctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccct

SEQ ID NO: 2936 - DNA, 500 bp, Homo sapiens
gtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaacca

SEQ ID NO: 2937 - DNA, 36 bp, Homo sapiens
gagatgtgcccttctcagccctgtactggttcaact

SEQ ID NO: 2938 - DNA, 391 bp, Homo sapiens
taccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacg

SEQ ID NO: 2939 - DNA, 82 bp, Homo sapiens
gactgaagcttcaagatggctgaccaggaccctgcgggcatcagccccctccagcaaatggtggcctcaggcaccggggctg

SEQ ID NO: 2940 - DNA, 36 bp, Homo sapiens
aactttaagagtggtgtggatgcagactcttcttat

SEQ ID NO: 2941 - DNA, 500 bp, Homo sapiens
tggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggcctt

SEQ ID NO: 2942 - DNA, 374 bp, Homo sapiens
tgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgtt

SEQ ID NO: 2943 - DNA, 117 bp, Homo sapiens
tggtggtgtgggtgactggagcctcgagtggaattggtgaggagctggcttaccagttgtctaaactaggagtttctcttgtgctgtcagccagaagagtgcatgagctggaaaggg

SEQ ID NO: 2944 - DNA, 345 bp, Homo sapiens
ctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaaggg

SEQ ID NO: 2945 - DNA, 80 bp, Homo sapiens
gctggagtgcaatggcatgatctcggctcactgcaacctccacctactgggttcaagcaattctcctgcctcagcctccc

SEQ ID NO: 2946 - DNA, 119 bp, Homo sapiens
cttttccgcgggccccgcccaggcggctgcccgtgacctgcctgggcgcggggaactgaaagccggaaggggcaagacgggttcagttcgtcatggggctgtttggaaagacccaggag

SEQ ID NO: 2947 - DNA, 183 bp, Homo sapiens
ctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttg

SEQ ID NO: 2948 - DNA, 500 bp, Homo sapiens
aggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcacc

SEQ ID NO: 2949 - DNA, 500 bp, Homo sapiens
gtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcg

SEQ ID NO: 2950 - DNA, 108 bp, Homo sapiens
ttgcccaggctggtctcaaactcctggatcaagtgatctacctgcctcggcctcccaaagtgctgggactacaggcatgaaccactgcacctggcctctagtgttttc

SEQ ID NO: 2951 - DNA, 128 bp, Homo sapiens
ttgcccaggctggactcgaacctctgagctgaagtgatcctccccactcggtctcccaaagtgctgggattacaggcatgagcactgtgcctgttcaaacaactaaataaaccatgtctaaagaatga

SEQ ID NO: 2952 - DNA, 36 bp, Homo sapiens
tccctatatgatgctgagaacctaggcaaagagcac

SEQ ID NO: 2953 - DNA, 249 bp, Homo sapiens
tgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgagg

SEQ ID NO: 2954 - DNA, 341 bp, Homo sapiens
tgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacag

SEQ ID NO: 2955 - DNA, 36 bp, Homo sapiens
ggacacattgtgatcaaggcaacacctgagcgtctc

SEQ ID NO: 2956 - DNA, 36 bp, Homo sapiens
cttgaagatgggcaagagcttgactcatggtatgtt

SEQ ID NO: 2957 - DNA, 279 bp, Homo sapiens
ccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatg

SEQ ID NO: 2958 - DNA, 129 bp, Homo sapiens
ataatgcatttaatagaagaacattccatcgtggatccaacttatatagaagattttctattaacttacaggacatttcttgaaagtcctttggatgttgggatcaaactattggaatggtttaagatc

SEQ ID NO: 2959 - DNA, 500 bp, Homo sapiens
caaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctga

SEQ ID NO: 2960 - DNA, 500 bp, Homo sapiens
ttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttg

SEQ ID NO: 2961 - DNA, 500 bp, Homo sapiens
agaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgct

SEQ ID NO: 2962 - DNA, 36 bp, Homo sapiens
ctgtggtttcctgcattggtgagtagcttcagtata

SEQ ID NO: 2963 - DNA, 59 bp, Homo sapiens
aatctcagcttactgcaatctccgtctcctgagttcaagcagttctgcctcagcctcct

SEQ ID NO: 2964 - DNA, 44 bp, Homo sapiens
agaagacactgagacgatcttcactgtgcctgaaaggagagagg

SEQ ID NO: 2965 - DNA, 119 bp, Homo sapiens
aatttcacaaaagtagaactattcctgctaactggaagactgaattgaaagaagatagctctagcagtgaagcagaggaagaagaggaggaggaagatgatgaaaaagaaaaggaggat

SEQ ID NO: 2966 - DNA, 500 bp, Homo sapiens
gaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaa

SEQ ID NO: 2967 - DNA, 36 bp, Homo sapiens
aagctaacagtcattacggtcacaatgacgatgtcg

SEQ ID NO: 2968 - DNA, 36 bp, Homo sapiens
aaatactgacagtcagagtcattcttgccccatgga

SEQ ID NO: 2969 - DNA, 358 bp, Homo sapiens
ggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacatacactccttccaccaagttggaacatccttggaaattggaagagcacaagaggagatccagggcaaggccattgggatattctgaaacttgaatattttgttttgtgcagagataaagaccttttccatgca

SEQ ID NO: 2970 - DNA, 229 bp, Homo sapiens
actctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacag

SEQ ID NO: 2971 - DNA, 169 bp, Homo sapiens
actctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcagg

SEQ ID NO: 2972 - DNA, 240 bp, Homo sapiens
ggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttc

SEQ ID NO: 2973 - DNA, 500 bp, Homo sapiens
cagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacatacactccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcct

SEQ ID NO: 2974 - DNA, 36 bp, Homo sapiens
tccttggcccaggggctggaggccttttcctgactg

SEQ ID NO: 2975 - DNA, 473 bp, Homo sapiens
attactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctca

SEQ ID NO: 2976 - DNA, 444 bp, Homo sapiens
ccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaa

SEQ ID NO: 2977 - DNA, 233 bp, Homo sapiens
cacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagc

SEQ ID NO: 2978 - DNA, 36 bp, Homo sapiens
ctataactctgaagagagtcgcccttacacaaacaa

SEQ ID NO: 2979 - DNA, 500 bp, Homo sapiens
ttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcga

SEQ ID NO: 2980 - DNA, 36 bp, Homo sapiens
agggtgctcatgatgaagaggtactcaagacaattg

SEQ ID NO: 2981 - DNA, 342 bp, Homo sapiens
agtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaag

SEQ ID NO: 2982 - DNA, 36 bp, Homo sapiens
gggtactatgtagagaagacagctgaggatgccaag

SEQ ID NO: 2983 - DNA, 36 bp, Homo sapiens
tctgtcatcccctcacagactgcatacgaggattgg

SEQ ID NO: 2984 - DNA, 80 bp, Homo sapiens
tggggccgggcgggcggcggcagcggccaggtgcgcagcgagcgctccgagcggcgcgcaccaggcggatgccccagccg

SEQ ID NO: 2985 - DNA, 61 bp, Homo sapiens
gagtgaccctgcgacccactctttggaccagcagcggatgaataaagcttcctgtgttgtg

SEQ ID NO: 2986 - DNA, 36 bp, Homo sapiens
atggccgggtggaacgcctacatcgacaacctcatg

SEQ ID NO: 2987 - DNA, 384 bp, Homo sapiens
gtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacgccagctgaggtgggtgtcctggttggcaaagaccggtcaagtttttacgtgaatgggctgacacttgggggccagaaatgttcggtgatccgggactcactgctgcaggatggggaatttagcatggatcttcg

SEQ ID NO: 2988 - DNA, 36 bp, Homo sapiens
taacagccacaaggaccgtttcatttcagggagaga

SEQ ID NO: 2989 - DNA, 402 bp, Homo sapiens
ggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggt

SEQ ID NO: 2990 - DNA, 172 bp, Homo sapiens
ccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcag

SEQ ID NO: 2991 - DNA, 181 bp, Homo sapiens
ctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccgg

SEQ ID NO: 2992 - DNA, 36 bp, Homo sapiens
cctcctctatggggacagggtggatgtggcccatct

SEQ ID NO: 2993 - DNA, 36 bp, Homo sapiens
tcatcgcaaaactcctggctgatgaacttattagtc

SEQ ID NO: 2994 - DNA, 36 bp, Homo sapiens
gttcctggtgtttgacctgatgcggaagggagagct

SEQ ID NO: 2995 - DNA, 500 bp, Homo sapiens
atgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagat

SEQ ID NO: 2996 - DNA, 36 bp, Homo sapiens
catcgagctactggccacagagcgagactctatctc

SEQ ID NO: 2997 - DNA, 36 bp, Homo sapiens
gctcactcagttccacagcagcctcccccgttgccc

SEQ ID NO: 2998 - DNA, 73 bp, Homo sapiens
tcccggacaaaaaagctgctgatcccttgagcacactgcagtgaagctcccagctgacatgtcctgtccatgt

SEQ ID NO: 2999 - DNA, 118 bp, Homo sapiens
tgcggagttgctctctccgggctcagtggatccattgacaaggctggttctggtgaatgctgtctatttcagaggaaactgggatgaacagtttgacaaggagaacaccgaggagaga

SEQ ID NO: 3000 - DNA, 314 bp, Homo sapiens
gaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctactt

SEQ ID NO: 3001 - DNA, 36 bp, Homo sapiens
cgttgagtctgttttaaggtatggcttgccagtgaa

SEQ ID NO: 3002 - DNA, 500 bp, Homo sapiens
tttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaatttgggaaaatccagatccacatcattgtagagtctgagggttag

SEQ ID NO: 3003 - DNA, 25 bp, Homo sapiens
actgtcccaagccacttaccttccc

SEQ ID NO: 3004 - DNA, 57 bp, Homo sapiens
agacagttacctgtgtaatgtcaccttgtttaggaaggcagttgatgacttcagaca

SEQ ID NO: 3005 - DNA, 500 bp, Homo sapiens
ttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggttt

SEQ ID NO: 3006 - DNA, 451 bp, Homo sapiens
cttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctat

SEQ ID NO: 3007 - DNA, 85 bp, Homo sapiens
tgcttatctaccagaccctgtgctacacccatgatgacctgaggaatgtggacgtgggtgactttgtgctaaagccctgcgggct

SEQ ID NO: 3008 - DNA, 36 bp, Homo sapiens
tgggcttttgacttccagttttccagatcaagaaat

SEQ ID NO: 3009 - DNA, 500 bp, Homo sapiens
aataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaa

SEQ ID NO: 3010 - DNA, 500 bp, Homo sapiens
agaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcag

SEQ ID NO: 3011 - DNA, 500 bp, Homo sapiens
tgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattga

SEQ ID NO: 3012 - DNA, 195 bp, Homo sapiens
tgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcg

SEQ ID NO: 3013 - DNA, 500 bp, Homo sapiens
tgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttcca

SEQ ID NO: 3014 - DNA, 58 bp, Homo sapiens
gtgttggccaggatggtctcaatctcttgaccttgtgatccgcctacctcgtcctccc

SEQ ID NO: 3015 - DNA, 36 bp, Homo sapiens
ctgtgaaggacgagcagggtgagacagactgccttg

SEQ ID NO: 3016 - DNA, 36 bp, Homo sapiens
ttcagaaagacaaatctgggatgatgcagtgtgtga

SEQ ID NO: 3017 - DNA, 36 bp, Homo sapiens
aacatgatggcggataaagccaagaccaaggagaac

SEQ ID NO: 3018 - DNA, 36 bp, Homo sapiens
cactacatctggatcgacttcctggtgcagcggttt

SEQ ID NO: 3019 - DNA, 36 bp, Homo sapiens
tgcctttgactacttcagctgtcccccaaagttccc

SEQ ID NO: 3020 - DNA, 36 bp, Homo sapiens
ccatctccaagaaatcaggcatgtctaagaaaacca

SEQ ID NO: 3021 - DNA, 36 bp, Homo sapiens
gtgaacttgaaaaagaaggtctgcggtgccgctcag

SEQ ID NO: 3022 - DNA, 36 bp, Homo sapiens
gccatatcatccacatcgactttggcttcatgtttg

SEQ ID NO: 3023 - DNA, 36 bp, Homo sapiens
gtgtccagcatctctcaggtcagccctgaacgcggc

SEQ ID NO: 3024 - DNA, 440 bp, Homo sapiens
agatgccagtgaggtccctccctttactgtagatgccagtgtgacccttcccttcactgtagatgccagcgaggtccctccattcactgtagatgccagcgaggtccctccattcactgtagatgccagcgaggtccctccctttactgtagatgccagcaaggtccctcccttcactgtagatgccagcatggcccttcccttcactgtagatgccagcgaggtccttctgtctgctcagacgtctttgactccctcttatgcacatcccacagatgactctcagcacatcccatcaccttcacctttgaggtttatccaggatctgacaagtcccagcatcccagctgctgccctctggcctggcctcctgctccccaaccccaggcatcttccccttctccacatgcggttggcgcaagccaggggggaatcagagc

SEQ ID NO: 3025 - DNA, 500 bp, Homo sapiens
ggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctttactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgagtgctgcctgtgtggacctcatggtgtgggctgtgaaggacgagcagggtgcagaaaacctt

SEQ ID NO: 3026 - DNA, 224 bp, Homo sapiens
ctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagt

SEQ ID NO: 3027 - DNA, 500 bp, Homo sapiens
tcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgtttgcccgatgggactgccctagagcctgagtactacttttcaaccatcagctccagcttctcagtctctccccttttcaacggtgtcacatataaggagtttaacattccattggaaatgctt

SEQ ID NO: 3028 - DNA, 500 bp, Homo sapiens
ctttactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgagtgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacac

SEQ ID NO: 3029 - DNA, 500 bp, Homo sapiens
ccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgtttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctttactacacttccttcagtgaccctctctacctgaccatgttcaagatgctgcgtgaca

SEQ ID NO: 3030 - DNA, 500 bp, Homo sapiens
ttgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacagggctggccatggcc

SEQ ID NO: 3031 - DNA, 500 bp, Homo sapiens
gaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacagggctggccatggccactgagagcatccttcactttgctggctacaacaagcagaacacaactcttggggcaactcagctgagcga

SEQ ID NO: 3032 - DNA, 500 bp, Homo sapiens
tgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatct

SEQ ID NO: 3033 - DNA, 500 bp, Homo sapiens
ccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgac

SEQ ID NO: 3034 - DNA, 500 bp, Homo sapiens
atcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtc

SEQ ID NO: 3035 - DNA, 186 bp, Homo sapiens
tgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtga

SEQ ID NO: 3036 - DNA, 36 bp, Homo sapiens
aatctgggccctgcccaggacctcagcagccatgtc

SEQ ID NO: 3037 - DNA, 81 bp, Homo sapiens
attcagctctgagcggtctttgctagtgaggccaaggagccaccctgagccaaaaggggagcattatgtcaccggaagccc

SEQ ID NO: 3038 - DNA, 457 bp, Homo sapiens
gttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtc

SEQ ID NO: 3039 - DNA, 296 bp, Homo sapiens
ggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 3040 - DNA, 155 bp, Homo sapiens
ctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtc

SEQ ID NO: 3041 - DNA, 377 bp, Homo sapiens
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaag

SEQ ID NO: 3042 - DNA, 36 bp, Homo sapiens
tacgcccgcctgcccaaggaccccaagatccgggaa

SEQ ID NO: 3043 - DNA, 36 bp, Homo sapiens
gcaaacgggaattctcgcccgagcctcttgaagcca

SEQ ID NO: 3044 - DNA, 36 bp, Homo sapiens; identical to SEQ ID NO: 3043

SEQ ID NO: 3045 - DNA, 265 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaa

SEQ ID NO: 3046 - DNA, 36 bp, Homo sapiens
gaggaggaagtgccccaggatataccccctacagaa

SEQ ID NO: 3047 - DNA, 500 bp, Homo sapiens
cctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagt

SEQ ID NO: 3048 - DNA, 500 bp, Homo sapiens
gatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctg

SEQ ID NO: 3049 - DNA, 500 bp, Homo sapiens
taagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgg

SEQ ID NO: 3050 - DNA, 36 bp, Homo sapiens
gtcttccggatggaacttgtttgacttctccgtgac

SEQ ID NO: 3051 - DNA, 95 bp, Homo sapiens
cagtttgtcgaggccatcgtggtgttggtacggcagatgtcccatgtgcgggtgacccgagcactgcgctgcattttcctggtggactgtcggta

SEQ ID NO: 3052 - DNA, 500 bp, Homo sapiens
cactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgt

SEQ ID NO: 3053 - DNA, 36 bp, Homo sapiens
cgccaggagcagggccaggtcactttgtctgtcccc

SEQ ID NO: 3054 - DNA, 36 bp, Homo sapiens
tgattctccccaccagaggacagacgttgaaagata

SEQ ID NO: 3055 - DNA, 36 bp, Homo sapiens
agaccctcaagccatctggttttcatgaggatgacc

SEQ ID NO: 3056 - DNA, 102 bp, Homo sapiens
ctcatcccactgatgacaccacgacgctctctgagagaccatccccaagcacagacgtccagacagacccccagaccctcaagccatctggttttcatgagg

SEQ ID NO: 3057 - DNA, 36 bp, Homo sapiens
gacacaagcaggacagatgtgagtgaaccagcaact

SEQ ID NO: 3058 - DNA, 175 bp, Homo sapiens
cgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgca

SEQ ID NO: 3059 - DNA, 36 bp, Homo sapiens
ccgccatcgtcctcacagtcttacacagtgtgggcc

SEQ ID NO: 3060 - DNA, 36 bp, Homo sapiens
cagccaggatatgatctgggtaacgtcattccagcc

SEQ ID NO: 3061 - DNA, 36 bp, Homo sapiens
tcgagttcctgacctcaggtaatccacctgcctcag

SEQ ID NO: 3062 - DNA, 36 bp, Homo sapiens
tgaaaagggaaagcaaaggaaccggcgaatatttgg

SEQ ID NO: 3063 - DNA, 435 bp, Homo sapiens
gaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtgga

SEQ ID NO: 3064 - DNA, 36 bp, Homo sapiens
tcccctgcaccccaccaggcaccccgactatgatga

SEQ ID NO: 3065 - DNA, 36 bp, Homo sapiens
gccagaagaggcccagcggtgagagcacactgccgg

SEQ ID NO: 3066 - DNA, 36 bp, Homo sapiens
ccttcctggacaccctgggtgagccctgcccacccc

SEQ ID NO: 3067 - DNA, 500 bp, Homo sapiens
cgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttggaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtgatcccagctactcgggaggctaaggcaggagaatcacttgaacccaggaggcagaggttggggtgagctg

SEQ ID NO: 3068 - DNA, 425 bp, Homo sapiens
catgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtgatcccagctactcgggaggctaaggcaggagaatcacttgaacccaggaggcagaggttggggtgagctgagattgcgccaccgcactccagcctgggcaacagagcgagactccatctcaaacaaaaacaagaacaaaaacaaacataaagttggcacagaaaagggaccaagtttaaaaaagggttttaaatgtaatgagacttgc

SEQ ID NO: 3069 - DNA, 500 bp, Homo sapiens
gggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgag

SEQ ID NO: 3070 - DNA, 500 bp, Homo sapiens
gcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggcta

SEQ ID NO: 3071 - DNA, 36 bp, Homo sapiens
agagctggagtatctcaggtaagtgtgccaactatg

SEQ ID NO: 3072 - DNA, 36 bp, Homo sapiens
agaaccatgtgtttttaggtctgttttctatcgctc

SEQ ID NO: 3073 - DNA, 44 bp, Homo sapiens
cttttgatttcaagagttaggagctcgagaaccgtttggcaata

SEQ ID NO: 3074 - DNA, 25 bp, Homo sapiens
ggctcccacctctgcagcccaagct

SEQ ID NO: 3075 - DNA, 334 bp, Homo sapiens
ctccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtgg

SEQ ID NO: 3076 - DNA, 62 bp, Homo sapiens
gatcttggctaactgcaacctccgcctcccgggttcaagcaattctcctgcctcagcctcct

SEQ ID NO: 3077 - DNA, 36 bp, Homo sapiens
ggttgacgtagtatctgatgactttctggctgatca

SEQ ID NO: 3078 - DNA, 36 bp, Homo sapiens
atcattttcaaaaagaagggaacacggatgcttaaa

SEQ ID NO: 3079 - DNA, 500 bp, Homo sapiens
ggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcacattgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactc

SEQ ID NO: 3080 - DNA, 63 bp, Homo sapiens
ggtgttcaagtattccagcaaagcagtcgtggagaaaacatgatgttggaaatcttagtggat

SEQ ID NO: 3081 - DNA, 500 bp, Homo sapiens
tcatcagtgcttggaaaatctgtctttgttaattggcctcacattgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttca

SEQ ID NO: 3082 - DNA, 500 bp, Homo sapiens
gagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcacattgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagt

SEQ ID NO: 3083 - DNA, 111 bp, Homo sapiens
agcaaatgtgggtttaaatctcaaattcaacaagaaaaatgaggaggtacctggatatactaagaaagttggaagtgaatggatgtattcatctgcagcagaacaacttct

SEQ ID NO: 3084 - DNA, 121 bp, Homo sapiens
gaaattctaaaaattgatggctctaacactgtggaccataagaatgaaatcaaacagattgctaatgaaatccctgtttcctctaacagaagagatgaatatggattaccctctcagccta

SEQ ID NO: 3085 - DNA, 36 bp, Homo sapiens
ccgtggggcccaaagaagccccttcgcagctccgtg

SEQ ID NO: 3086 - DNA, 109 bp, Homo sapiens
tgcccaagctggagtgcaaaggtgcaatcttggctcactgcaacttccgcctcccgggttcaagtgattctcctgcctcagcctctcgagtagctgggattacaggcat

SEQ ID NO: 3087 - DNA, 97 bp, Homo sapiens
ggccaggttggtctccaactcctgacctcaagtgatccacccgcctcagcctcccaaagtgctgggattacagatgtgagtcactgcacccggcctg

SEQ ID NO: 3088 - DNA, 80 bp, Homo sapiens
tggccaggttggtctccaactcctgacctcaagtgatccacccgcctcagcctcccaaagtgctgggattacagatgtga

SEQ ID NO: 3089 - DNA, 82 bp, Homo sapiens
aggctggagtgcagtggcatgatcttggttcactgcaacctctgcttctgggattcaagagattctcccgcctcagcctccg

SEQ ID NO: 3090 - DNA, 36 bp, Homo sapiens
gcagtctgagcacaacaggtcagggagggcagaaaa

SEQ ID NO: 3091 - DNA, 36 bp, Homo sapiens
cctactttctctttgcagaacccccaaaataagacc

SEQ ID NO: 3092 - DNA, 36 bp, Homo sapiens
actggccccagtacaaagatcaaggctgaagacccc

SEQ ID NO: 3093 - DNA, 36 bp, Homo sapiens
gcagtctgagcacaacagaagcacaatggtggggtt

SEQ ID NO: 3094 - DNA, 500 bp, Homo sapiens
cagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggttt

SEQ ID NO: 3095 - DNA, 36 bp, Homo sapiens
cataggaagaaagtccagaaataagaatgtctaagc

SEQ ID NO: 3096 - DNA, 36 bp, Homo sapiens
gctgcgtctgcccaagagaaataagaatgtctaagc

SEQ ID NO: 3097 - DNA, 36 bp, Homo sapiens
ggcagccagctagctggggcctgctaccgacaccaa

SEQ ID NO: 3098 - DNA, 106 bp, Homo sapiens
atgggcaagctctacggcaacgacttcagccagacgaccatttcccgcttcgaggccctcaacctgagcttcaagaacatgtgcaaactcaagcccctcctggaga

SEQ ID NO: 3099 - DNA, 500 bp, Homo sapiens
ctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggc

SEQ ID NO: 3100 - DNA, 165 bp, Homo sapiens
gcaacagatactaaacctgatagggatatcgagttagagctttcagcacttgatactgatgaacctgatggacaaagtgaaccaattgaaagatcttggacatacagcttggtatcagttctcaaaatgatcagttgctaaatggaatggcagtggaaaatgggc

SEQ ID NO: 3101 - DNA, 221 bp, Homo sapiens
taaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggat

SEQ ID NO: 3102 - DNA, 77 bp, Homo sapiens
tggagtgcaatggtgccatcatagctcattataactttgaattcctgggatcaaccagtcctcccgcctcagcttcc

SEQ ID NO: 3103 - DNA, 36 bp, Homo sapiens
gagcgggtgctgctagcggaggcgccatattggagg

SEQ ID NO: 3104 - DNA, 36 bp, Homo sapiens
gcggaaacctgaaagaaggtcagtgttgtgggagtg

SEQ ID NO: 3105 - DNA, 500 bp, Homo sapiens
tattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttatt

SEQ ID NO: 3106 - DNA, 500 bp, Homo sapiens
gtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagact

SEQ ID NO: 3107 - DNA, 36 bp, Homo sapiens
gcactttgggaggccaaggcaggcagatcacttgag

SEQ ID NO: 3108 - DNA, 339 bp, Homo sapiens
atgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaac

SEQ ID NO: 3109 - DNA, 178 bp, Homo sapiens
ctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatcc

SEQ ID NO: 3110 - DNA, 123 bp, Homo sapiens
gaggcccttcaagatttcttccgcctctttccggagtacaagaacaacaaacttttcctgaccggggagagctatgctggcatctacatccccaccctggccgtgctggtcatgcaggatccc

SEQ ID NO: 3111 - DNA, 36 bp, Homo sapiens
attacatgccacccccttatgcctctttgacaaggc

SEQ ID NO: 3112 - DNA, 500 bp, Homo sapiens
gggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaa

SEQ ID NO: 3113 - DNA, 500 bp, Homo sapiens
ttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgta

SEQ ID NO: 3114 - DNA, 128 bp, Homo sapiens
acactccagatctcattggagccagggttccagttctcatgcaagtcggccacaggagccacggaaccgcagtaggatttctactgttatacagcccttgaggcagaatgcagcagaagttgtggacc

SEQ ID NO: 3115 - DNA, 500 bp, Homo sapiens
aaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggacc

SEQ ID NO: 3116 - DNA, 36 bp, Homo sapiens
cagtctgagtccaagaccgtgagtacatgggtgagg

SEQ ID NO: 3117 - DNA, 500 bp, Homo sapiens
gggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctc

SEQ ID NO: 3118 - DNA, 36 bp, Homo sapiens
atcctgcttcacttccagccctgcctctttcttgtc

SEQ ID NO: 3119 - DNA, 36 bp, Homo sapiens
cttcccatgtgatgtaagttttccagccaatatcag

SEQ ID NO: 3120 - DNA, 36 bp, Homo sapiens
taccaatggtcgacgatggtggaaatatgcaattga

SEQ ID NO: 3121 - DNA, 36 bp, Homo sapiens
ataaaagaaaatgccctgagtgaattggatgttcct

SEQ ID NO: 3122 - DNA, 36 bp, Homo sapiens
cctcacatacaaacagagtgggtcaccagaagaaat

SEQ ID NO: 3123 - DNA, 36 bp, Homo sapiens
gaacatgatctgttaaaggatggatgtggacagttt

SEQ ID NO: 3124 - DNA, 36 bp, Homo sapiens
tctttggacacacagtaggtggtgcagcaggagttg

SEQ ID NO: 3125 - DNA, 36 bp, Homo sapiens
cttccaaggcattcagagggcagcagaatcaactga

SEQ ID NO: 3126 - DNA, 36 bp, Homo sapiens
gacaccgccacagcagaggtaaacaatttaaagagc

SEQ ID NO: 3127 - DNA, 500 bp, Homo sapiens
ttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgag

SEQ ID NO: 3128 - DNA, 156 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctga

SEQ ID NO: 3129 - DNA, 200 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacag

SEQ ID NO: 3130 - DNA, 243 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaag

SEQ ID NO: 3131 - DNA, 500 bp, Homo sapiens
acaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgc

SEQ ID NO: 3132 - DNA, 500 bp, Homo sapiens
cttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcac

SEQ ID NO: 3133 - DNA, 136 bp, Homo sapiens
ttctgttcttgaagttcatataagaaggtatacacagatgtggtcatggagtaacataaaaaagcacaggcagttactcaagagttataaaattgcctacaaaaacaagttaacacagtctaaagtctcagaagaa

SEQ ID NO: 3134 - DNA, 94 bp, Homo sapiens
aaattaaggaaaaagtctgctgacacaggcgagaaacgtggaggctggtttagtgggttgtggggtaagaaagagtctaagaaaaaggacgaag

SEQ ID NO: 3135 - DNA, 500 bp, Homo sapiens
acttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagc

SEQ ID NO: 3136 - DNA, 94 bp, Homo sapiens
acttcctttgatgcatgtgagaatttctgaccagaagatgaaagatgtgctatatttgatgaacagtatacctttgccacagaaatcatcagcc

SEQ ID NO: 3137 - DNA, 500 bp, Homo sapiens
atttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggc

SEQ ID NO: 3138 - DNA, 500 bp, Homo sapiens
ttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatct

SEQ ID NO: 3139 - DNA, 500 bp, Homo sapiens
acaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactc

SEQ ID NO: 3140 - DNA, 500 bp, Homo sapiens
cattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttgg

SEQ ID NO: 3141 - DNA, 500 bp, Homo sapiens
accagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcct

SEQ ID NO: 3142 - DNA, 500 bp, Homo sapiens
gatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggt

SEQ ID NO: 3143 - DNA, 98 bp, Homo sapiens
gatgtaaacactgccgaacattcaactgtcataactttttctgattaccatgagggatctgcacctgccttgataatgaaccatacaccatgggacat

SEQ ID NO: 3144 - DNA, 500 bp, Homo sapiens
ggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgata

SEQ ID NO: 3145 - DNA, 91 bp, Homo sapiens
ggtcttgctgccaagacaggctcgactttttgcctgggcagatcctactggtaccagaaaacttacatggacatatgcagcaaatgttggg

SEQ ID NO: 3146 - DNA, 500 bp, Homo sapiens
gtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcat

SEQ ID NO: 3147 - DNA, 500 bp, Homo sapiens
gaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgactt

SEQ ID NO: 3148 - DNA, 500 bp, Homo sapiens
aatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcc

SEQ ID NO: 3149 - DNA, 48 bp, Homo sapiens
aaaaaagacagtgccaatcaaggctgtgttcgaaaagtttacctgaag

SEQ ID NO: 3150 - DNA, 36 bp, Homo sapiens
tcttttttttcttctcagcttaccacagtgcggaga

SEQ ID NO: 3151 - DNA, 379 bp, Homo sapiens
agacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgg

SEQ ID NO: 3152 - DNA, 239 bp, Homo sapiens
ctcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaa

SEQ ID NO: 3153 - DNA, 36 bp, Homo sapiens
ctcccattctggttaaaggccagtctgccatccatc

SEQ ID NO: 3154 - DNA, 36 bp, Homo sapiens
gactcttcattccaatggaagaacaagacaatgaag

SEQ ID NO: 3155 - DNA, 36 bp, Homo sapiens
agtggcatattatcagaggtaaatcggcatcataca

SEQ ID NO: 3156 - DNA, 219 bp, Homo sapiens
tccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcata

SEQ ID NO: 3157 - DNA, 154 bp, Homo sapiens
gctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactg

SEQ ID NO: 3158 - DNA, 500 bp, Homo sapiens
caaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaa

SEQ ID NO: 3159 - DNA, 136 bp, Homo sapiens
gctcaaagctccatcgcccttcaccatcagtacaaccccaagtttcagaccctgttccaaccctgtaacttgatgggagctatgcagctgattgaagacttcagcacacatgtcagcattgactgcagccctcata

SEQ ID NO: 3160 - DNA, 500 bp, Homo sapiens
cctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagct

SEQ ID NO: 3161 - DNA, 500 bp, Homo sapiens
caggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttc

SEQ ID NO: 3162 - DNA, 36 bp, Homo sapiens
cggcgccctccacaacagaggtgcccccacccccga

SEQ ID NO: 3163 - DNA, 61 bp, Homo sapiens
tggccgctgggtgggctccaggggaggggagctcctctgaaccaaccatcctgtccccact

SEQ ID NO: 3164 - DNA, 36 bp, Homo sapiens
cagccgcagcaggttcaggtccaggtgcaggtacag

SEQ ID NO: 3165 - DNA, 500 bp, Homo sapiens
aatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagc

SEQ ID NO: 3166 - DNA, 66 bp, Homo sapiens
cagcagtctccgcaacaggtctcggctcagctctccccacaactcaccgttcaccagcctactgag

SEQ ID NO: 3167 - DNA, 398 bp, Homo sapiens
gaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttca

SEQ ID NO: 3168 - DNA, 36 bp, Homo sapiens
caacaagcacctctgaagtcttctcattcacaggtt

SEQ ID NO: 3169 - DNA, 500 bp, Homo sapiens
ttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatataccctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccagcagtttgggaggctgagggcaggtggatcacttgagatcgggagttcgtgacca

SEQ ID NO: 3170 - DNA, 379 bp, Homo sapiens
agcagatgactgaagccttattgtctggagaaattaaaccaaacagacttagaactgaggacagggggaggatggtaatggtagtgatgtgctatatggaagacaaaatgattaacagaatgaagccacttggaggatgtgctttaccaaaatgagggagtaatctgagaaggcatgggatcctgaaactaaaagatgtcacaaaggaaaacgaggaaagtcccaggatgactactgtgtcaagtaagtaggacagaggttccaggaagtaggtatctaggaaaactgggaacaaagtatttgagtacaatggaaagtgtataaataagcaggaaatttgaaattttatttcttagaaagtatgttatttagtaatcag

SEQ ID NO: 3171 - DNA, 83 bp, Homo sapiens
taggatcacaacttctgaggtcccagcaagagtcctaacatctagcagctctaccaccaggacaggccccctaaaactaattc

SEQ ID NO: 3172 - DNA, 272 bp, Homo sapiens
gataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctaga

SEQ ID NO: 3173 - DNA, 156 bp, Homo sapiens
gataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactga

SEQ ID NO: 3174 - DNA, 36 bp, Homo sapiens
tctgagttgactttttaggtgccacgtgtgccaacg

SEQ ID NO: 3175 - DNA, 36 bp, Homo sapiens
tttctactagtccagttgggttaccatccattgacc

SEQ ID NO: 3176 - DNA, 500 bp, Homo sapiens
gaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctac

SEQ ID NO: 3177 - DNA, 500 bp, Homo sapiens
cgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattca

SEQ ID NO: 3178 - DNA, 321 bp, Homo sapiens
gctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaat

SEQ ID NO: 3179 - DNA, 141 bp, Homo sapiens
catcaggcagctccccatcttcctcttctgctcctctggcaagtttttccggcataccaggaacaagggttttcctgcaagggccagctcctgttgggactcctagtttcaacagacaacatttttctccccatccttgga

SEQ ID NO: 3180 - DNA, 373 bp, Homo sapiens
atcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacaca

SEQ ID NO: 3181 - DNA, 500 bp, Homo sapiens
ccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacag

SEQ ID NO: 3182 - DNA, 107 bp, Homo sapiens
gctcgaggtgcaaataaagaacataggaacgtatctgattatacaccactgagtctagctgcgtctggaggatatgttaatatcattaagattctgcttaatgctgg

SEQ ID NO: 3183 - DNA, 500 bp, Homo sapiens
tatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataacc

SEQ ID NO: 3184 - DNA, 500 bp, Homo sapiens
tggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctctt

SEQ ID NO: 3185 - DNA, 500 bp, Homo sapiens
aagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacggga

SEQ ID NO: 3186 - DNA, 36 bp, Homo sapiens
tcctgggttcaaacgattctcctgcctcagcctccc

SEQ ID NO: 3187 - DNA, 36 bp, Homo sapiens; identical to SEQ ID NO: 3186

SEQ ID NO: 3188 - DNA, 500 bp, Homo sapiens
ctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccct

SEQ ID NO: 3189 - DNA, 36 bp, Homo sapiens
ctagctgaaatgtctcaggcaaaaatagacatctta

SEQ ID NO: 3190 - DNA, 26 bp, Homo sapiens
tctccagcctcagcctcctgagtacc

SEQ ID NO: 3191 - DNA, 36 bp, Homo sapiens
tcaccctgaactcggaagaggactaccccaatggca

SEQ ID NO: 3192 - DNA, 500 bp, Homo sapiens
cccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatgaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtg

SEQ ID NO: 3193 - DNA, 36 bp, Homo sapiens
cggctcactacaacctctgcctcccaggttcaaatg

SEQ ID NO: 3194 - DNA, 60 bp, Homo sapiens
attgagaccaagatgcacgtccgcttccttaacatggaaaccatggccctctgccactga

SEQ ID NO: 3195 - DNA, 498 bp, Homo sapiens
atgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccgcatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccggga

SEQ ID NO: 3196 - DNA, 498 bp, Homo sapiens
tttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccgcatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcag

SEQ ID NO: 3197 - DNA, 36 bp, Homo sapiens
atttgtcgagctcatcaggtggtggaagatggatat

SEQ ID NO: 3198 - DNA, 237 bp, Homo sapiens
atattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggt

SEQ ID NO: 3199 - DNA, 99 bp, Homo sapiens
gaattttttgctaaacgacagttggtaaccttattttcagccccaaattactgtggcgagtttgataatgctggtggaatgatgagtgtggatgaaact

SEQ ID NO: 3200 - DNA, 36 bp, Homo sapiens
ctcaagcaattctcctgcctcaaccttccgaatagc

SEQ ID NO: 3201 - DNA, 99 bp, Homo sapiens
tttgttcttgaaccacacccgttcgatcctagagttctcttttctgctggtcatgatggaaacgtgatagtgtgggatctggcaagaggagtcaaaata

SEQ ID NO: 3202 - DNA, 41 bp, Homo sapiens
gtcagtggtggaacatccgaagaagaagagagagcatggca

SEQ ID NO: 3203 - DNA, 36 bp, Homo sapiens
attttctttttgattcagattggcccaagagagaga

SEQ ID NO: 3204 - DNA, 62 bp, Homo sapiens
gaggagtaggaagtaatatgagcaggaactcttgggaggccagaacaaccaacctgcgtatg

SEQ ID NO: 3205 - DNA, 500 bp, Homo sapiens
acttcataacctcctaatggtacacaccccaccaagatggccttttcttttcttttttttctgagatgcagtctcactctgtcaccaggctggagtgcagtggcgcgatctcagctcactgcaacctccgcctcccgggttcaagtgattcccctgcctcagcctcctgagtagctgggactacaggcgcgtgccaccacgcccagctaattttttgtattttagtagagatgggtttcaccatgttggccaggatggtctcgatctcctgacctcgtgatctgcccacctcagcctcccaaagtgctgggattacaggcgtaagccagcacgcctggtcctttattttcttttcttttttctttcttttttttgagatagagtcttgctctgtcacccaggctggagtgcagtggcgcggtcttggcttaccgtaacctctgcctcctaagtagcttggattacagatgcccgccaccatgcctggctaattcttgtat

SEQ ID NO: 3206 - DNA, 36 bp, Homo sapiens
gatttttccattccgtagacctcctggcattggagc

SEQ ID NO: 3207 - DNA, 36 bp, Homo sapiens
ggggtcgcatcgtgccaggtaggggctgggggcggg

SEQ ID NO: 3208 - DNA, 36 bp, Homo sapiens
cgagcggcagcgaaaaattcgacagcaagaaataga

SEQ ID NO: 3209 - DNA, 36 bp, Homo sapiens
agaacactgagaacaaaggtgaaatgtctagaagat

SEQ ID NO: 3210 - DNA, 84 bp, Homo sapiens
ctcatcagagaaatagacaaattaaaggaagacattaactctcacgtcatcaaagtaaagtgggcacaaaacaaattaaaagct

SEQ ID NO: 3211 - DNA, 36 bp, Homo sapiens
cgcaggagatgatggaggttgacaggcgggtcgagt

SEQ ID NO: 3212 - DNA, 36 bp, Homo sapiens
caaagtaacaaacaacaggttcctacaaacttgatg

SEQ ID NO: 3213 - DNA, 25 bp, Homo sapiens
gcgatcctcctgcctcagcctccca

SEQ ID NO: 3214 - DNA, 57 bp, Homo sapiens
aaccttcatgcacttatggcagtggtttctggcctacagagtgccccaattttcagg

SEQ ID NO: 3215 - DNA, 241 bp, Homo sapiens
gtgtctatggcatggaccttctctggccaagttttgaccggcctgactgaccttgaaattttgatgaaacagccaatcaaagatctctgatctacacaggcctaccatggccctgttctgcagccccacttgggggatggaggacccttgcctcctccctctcctgcagccccagagacgggtgaagggtcgtgagcgcttccctggtcccccaacacacggtacacctttgccccaatgt

SEQ ID NO: 3216 - DNA, 37 bp, Homo sapiens
ttagctcactgcaacctccgccttccagtttcaagcg

SEQ ID NO: 3217 - DNA, 36 bp, Homo sapiens
gtagaccatctcaagcagaacaacacagctaaactg

SEQ ID NO: 3218 - DNA, 36 bp, Homo sapiens
gcagtacccagcctgctgagaaagataagaagaaac

SEQ ID NO: 3219 - DNA, 36 bp, Homo sapiens
ccgtgcttctttccccaggactagagctggagacac

SEQ ID NO: 3220 - DNA, 500 bp, Homo sapiens
ctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaacc

SEQ ID NO: 3221 - DNA, 70 bp, Homo sapiens
catccttggtgcctgtgaagaagaatgccagcacagtggtggtttctgacaagtacaaccttaaacccat

SEQ ID NO: 3222 - DNA, 500 bp, Homo sapiens
gtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacg

SEQ ID NO: 3223 - DNA, 138 bp, Homo sapiens
gtaaagatgaaggaaaaagtcgaactacccttcctgagcgacctttgacagaggtgaaggctgagacccgggctgaggaggccccagagaagaagagggagaagcccaagtctcttcgcaccacagcacccagtcatg

SEQ ID NO: 3224 - DNA, 500 bp, Homo sapiens
cttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccat

SEQ ID NO: 3225 - DNA, 500 bp, Homo sapiens
cacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtga

SEQ ID NO: 3226 - DNA, 125 bp, Homo sapiens
aaggaagaggtggcagtgctgattcaggtggtcctttgccattccaaaagaaagctggattgccttaccaaatctccaggtttttcgttatacctcttcactcaggctctgcccagaactcaagg

SEQ ID NO: 3227 - DNA, 36 bp, Homo sapiens
tggcaaaactggcagaaggcgctggaatccaactgc

SEQ ID NO: 3228 - DNA, 36 bp, Homo sapiens
atccagcagctctgactgctctgagtccagccctga

SEQ ID NO: 3229 - DNA, 36 bp, Homo sapiens
tgcggggacccggaactgatctgacaggatggcatc

SEQ ID NO: 3230 - DNA, 36 bp, Homo sapiens
ccctataaaaaagaagaggatgagcaacaaaggaaa

SEQ ID NO: 3231 - DNA, 196 bp, Homo sapiens
ttttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagct

SEQ ID NO: 3232 - DNA, 36 bp, Homo sapiens
catttcagatcggaactcacgtcgttctaagggcat

SEQ ID NO: 3233 - DNA, 500 bp, Homo sapiens
gagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccag

SEQ ID NO: 3234 - DNA, 500 bp, Homo sapiens
gtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttcc

SEQ ID NO: 3235 - DNA, 341 bp, Homo sapiens
cagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggcc

SEQ ID NO: 3236 - DNA, 36 bp, Homo sapiens
ctgctacccccgagtgtccagtgctgtgaaggcgga

SEQ ID NO: 3237 - DNA, 81 bp, Homo sapiens
gccacagtggaggagacagtggtgcgggacaaggcagtggagtccttacgggccatctcacacgagcactcgccctctgac

SEQ ID NO: 3238 - DNA, 36 bp, Homo sapiens
aaagactgtgaggccgaggtgagggccgcagcctcc

SEQ ID NO: 3239 - DNA, 500 bp, Homo sapiens
ctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatg

SEQ ID NO: 3240 - DNA, 138 bp, Homo sapiens
aacatcatctctaacctggactgtgtgaacgaggtgattggcatccggcagctgtcccagtccctgctccctgccattgtggagctggctgaggacgccaagtggcgggtgcggctggccatcattgagtacatgccc

SEQ ID NO: 3241 - DNA, 500 bp, Homo sapiens
cctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatgg

SEQ ID NO: 3242 - DNA, 36 bp, Homo sapiens
gaacagcgacatcgagaaaatcaccgaagattcagc

SEQ ID NO: 3243 - DNA, 36 bp, Homo sapiens
aaatgcctcatctgcatggactcgtactcgatgccc

SEQ ID NO: 3244 - DNA, 88 bp, Homo sapiens
gaacatttcctgagctcctgtgtgtagagcgttgtgctcggtgctgtttgcaagggaatcaaagaagtaggagatgatacttcctctt

SEQ ID NO: 3245 - DNA, 211 bp, Homo sapiens
tccccaccccaagctccatgcttctcacggctatgtcttgcgtccctgcatctgtacccctcacgtcgcggcccagcccagcacccctacgcccatgccccctccgtctgtgcgcgccctgcgcccccggcacgcgcccccctccaaccgggtgtctgacagccggacagcgggatctgcacagcaagtgaaattcccgtcggatcgataa

SEQ ID NO: 3246 - DNA, 292 bp, Homo sapiens
ggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtat

SEQ ID NO: 3247 - DNA, 142 bp, Homo sapiens
ggaaggagagtctccaacggcatcaccccactcatctgccaccgatgacctccaccattcagacagataccagacctttctgcgagtacgagccaaccggcagacccgactgaatgctcggattgggaaaatgaaacggagg

SEQ ID NO: 3248 - DNA, 105 bp, Homo sapiens
gctgaggatgatgctgtggacatcgagcatgagaacaacaaccgctttgaggagtatgagtggtgtggacagaagcggatacgggccaccactctcctggaaggt

SEQ ID NO: 3249 - DNA, 500 bp, Homo sapiens
tgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtgggg

SEQ ID NO: 3250 - DNA, 36 bp, Homo sapiens
ctttgcatagaggtcaagcttttcacatcctgaaca

SEQ ID NO: 3251 - DNA, 36 bp, Homo sapiens
ttcccacctgtcctggaggtaatgatgcaaaatctg

SEQ ID NO: 3252 - DNA, 36 bp, Homo sapiens
aaaaagccgatttttcaggttttgtgtggctataaa

SEQ ID NO: 3253 - DNA, 36 bp, Homo sapiens
agcatacaggatgtacaggtggacaatcagctcatt

SEQ ID NO: 3254 - DNA, 500 bp, Homo sapiens
gtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattca

SEQ ID NO: 3255 - DNA, 500 bp, Homo sapiens
agaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatct

SEQ ID NO: 3256 - DNA, 144 bp, Homo sapiens
ggtttgtttgatggagctgaagttgttcttggtcctgacacttccatggagcttttggggccagttccacctgaacaacaatttattaatcaaaaaatgagacctggttctggaatgttatccatcagagtcatcccagatgga

SEQ ID NO: 3257 - DNA, 500 bp, Homo sapiens
gtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccagtttgccactactttgagcagctccattacaatgacatgtggctgaaggttggcgactgtgtcttcatcaagtcccatggcctggtgcgtcctcgtgtgggcagaattgaaaaagtatgggttcgagat

SEQ ID NO: 3258 - DNA, 62 bp, Homo sapiens
gccaggagagacgatatcgaggacggagacagcatgatctcttcagccacctctgatactgg

SEQ ID NO: 3259 - DNA, 500 bp, Homo sapiens
ccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccagtttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaaga

SEQ ID NO: 3260 - DNA, 36 bp, Homo sapiens
atccctccttcccaccaggcatccggtcttgggatg

SEQ ID NO: 3261 - DNA, 36 bp, Homo sapiens
ttttgtttcaactgccaaaggtgtgttgcagtcact

SEQ ID NO: 3262 - DNA, 36 bp, Homo sapiens
gcactattaaatgtgaggcagcctccatctactaca

SEQ ID NO: 3263 - DNA, 36 bp, Homo sapiens
accccgtcagttcagcagcagcagcctccatctact

SEQ ID NO: 3264 - DNA, 36 bp, Homo sapiens
gagtagctgggattacagatggtggagccagggcaa

SEQ ID NO: 3265 - DNA, 500 bp, Homo sapiens
acgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttg

SEQ ID NO: 3266 - DNA, 36 bp, Homo sapiens
tctgcaaagacaatgcagacttgttgagcccattaa

SEQ ID NO: 3267 - DNA, 241 bp, Homo sapiens
agagattttggcgttctgttggtttatggagagagttgatcagagattgctccttggctgagttgctgtctgcataggctgttaacaattgtttctctggcagcagatcttgttcatcaggattgcatcatttctgggagaatggccaaggtccacagcctcaatacaaagactgtctgaagcatatgaggcctgttctctttctgaagcggcactcctcttcctgccagtcctcttcaca

SEQ ID NO: 3268 - DNA, 500 bp, Homo sapiens
taaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaac

SEQ ID NO: 3269 - DNA, 500 bp, Homo sapiens
tgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagccct

SEQ ID NO: 3270 - DNA, 134 bp, Homo sapiens
acgatcatccctcgttctgacctgaatggcctgccgtcgcctgtagaggaacgctgtggagacagcccgaactctgaaggagaaactgtacctacctggtgtccttgtggtctttctcaggatggcttccttct

SEQ ID NO: 3271 - DNA, 36 bp, Homo sapiens
tctgcaaagacaatgcaggctcaaagagtccccagc

SEQ ID NO: 3272 - DNA, 500 bp, Homo sapiens
agaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaa

SEQ ID NO: 3273 - DNA, 500 bp, Homo sapiens
tagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccgga

SEQ ID NO: 3274 - DNA, 500 bp, Homo sapiens
aagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcgga

SEQ ID NO: 3275 - DNA, 500 bp, Homo sapiens
actcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaa

SEQ ID NO: 3276 - DNA, 57 bp, Homo sapiens
tggcccaggctggtcttgaactcctgacctcaagcgattctcctgccttgacctcct

SEQ ID NO: 3277 - DNA, 84 bp, Homo sapiens
ttggccaggctagtctcgaactccttacctcaagtgatccacccgcctcggccttccaaagtgctaggattaaaggcgtgaatc

SEQ ID NO: 3278 - DNA, 99 bp, Homo sapiens
cagctgccagtcctaggaaaatgctgtgaagagatccagccacatcagtggaagccacctatagagagagaagaacaccggctcccattctggttaaag

SEQ ID NO: 3279 - DNA, 104 bp, Homo sapiens
tgccaaagcaagtggcttggatcctggccacaagcaaggttttcatgtatccagagttacttccagtgtgttccctgaaggcaaagaatccccaggataagatc

SEQ ID NO: 3280 - DNA, 367 bp, Homo sapiens
gaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaac

SEQ ID NO: 3281 - DNA, 136 bp, Homo sapiens; identical to SEQ ID NO: 3159

SEQ ID NO: 3282 - DNA, 36 bp, Homo sapiens
tggtgggcctcattctaggtttgacttctgtgaacc

SEQ ID NO: 3283 - DNA, 41 bp, Homo sapiens
gctaacgcggcgaggtagctcggtgcgtctcgcggtaccag

SEQ ID NO: 3284 - DNA, 132 bp, Homo sapiens
gaaagttcagcaagcagtcttaccatggcccacgtgccctggcatgaggaagtggtacagtttgtccacgagttggtggatctgatccccgaatatgaaattgcatgtgaacacgaacactctaattgcctc

SEQ ID NO: 3285 - DNA, 36 bp, Homo sapiens
gcgctttcaaggcccaagtgagcacgctgctgactc

SEQ ID NO: 3286 - DNA, 36 bp, Homo sapiens
catctacacccactaccgcctgcccagtgtccgctt

SEQ ID NO: 3287 - DNA, 377 bp, Homo sapiens
aagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagttt

SEQ ID NO: 3288 - DNA, 500 bp, Homo sapiens
gtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatcta

SEQ ID NO: 3289 - DNA, 296 bp, Homo sapiens
agttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacct

SEQ ID NO: 3290 - DNA, 296 bp, Homo sapiens; identical to SEQ ID NO: 3289

SEQ ID NO: 3291 - DNA, 227 bp, Homo sapiens
aagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcct

SEQ ID NO: 3292 - DNA, 195 bp, Homo sapiens
gcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccct

SEQ ID NO: 3293 - DNA, 411 bp, Homo sapiens
ttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggac

SEQ ID NO: 3294 - DNA, 317 bp, Homo sapiens
tttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagat

SEQ ID NO: 3295 - DNA, 500 bp, Homo sapiens
cgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgt

SEQ ID NO: 3296 - DNA, 100 bp, Homo sapiens
cgctggaatgcaatggtgcgatctcggctcgctgcagcctccgcctcccagcttcaagcgattctcctgactcagcctcccaagtagctgggactacagg

SEQ ID NO: 3297 - DNA, 185 bp, Homo sapiens
ggctaaagtgcaggggcatgatttcagctcactgcaacctccacttcccaggttcgagcaattcccgtgcctcagccttccgagtagctgggattacagacgtttgccatcacccctggctaatttttatatttttagtacagactagaaatacaaaatattcaccagggacagtggcacacgcc

SEQ ID NO: 3298 - DNA, 334 bp, Homo sapiens
acccaggctggagtgtagtggtacaatcttggctcactacagcctccgcctcctgggttcaagcgattctcctgcctcagcctccagagtagctgggactacaggcatgcgccacgacgcccagctaatttttgtatttttagcagagacagggttttgccatgttggccaggctggtctcgaacttctgacctcaagtgatccacctgccctggcctcccaaagtgctgggattacaagtgtgagccaccgtacctggcctgctattacctcttaattagaatttgagttgtattcagtcttttgtcactaaataaatgcttctataaacatt

SEQ ID NO: 3299 - DNA, 500 bp, Homo sapiens
gttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaag

SEQ ID NO: 3300 - DNA, 500 bp, Homo sapiens
ctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcatt

SEQ ID NO: 3301 - DNA, 250 bp, Homo sapiens
tgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagagg

SEQ ID NO: 3302 - DNA, 124 bp, Homo sapiens
gcatgccaagcaccgtggccatgaagctatgcatgctgaaatggtcctcatcctcatcgcaaccttggtggtggcccagctgctcctggtgcagtggaagcagaggcacccacgctcctacaat

SEQ ID NO: 3303 - DNA, 500 bp, Homo sapiens
gggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgc

SEQ ID NO: 3304 - DNA, 83 bp, Homo sapiens
ttggccagactggtctcgaactcctggctacaagtgatccgcctgtctcagcctcccaaagtgttgggattacaggcatgagc

SEQ ID NO: 3305 - DNA, 100 bp, Homo sapiens
aggctggagtgtagtggcactatctcggctcactgcaacctctggccaggctgatctcgaactcctcacctcaggtgaactgcctgcctcggcctccaaa

SEQ ID NO: 3306 - DNA, 500 bp, Homo sapiens
atggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacg

SEQ ID NO: 3307 - DNA, 320 bp, Homo sapiens
gcacaggctggagtgcaatggcgtgatcttggctcactgcaacctccactgccagaattcaagcaattcacctgcctcagcctcctgagtagctgggattacagacgcacaccaccatgcccagctaattttgtatttttagtagagacagggtttcaccatgttgcccaggctggtcccgaactcctgacctcgggtgatccgcccacctcggcctcccaaagtgctgggattacaggcgtgagccaccacacctggcccacaccattttttatcagctttctaatgcatatcccctgttgctgatctctcttgtctat

SEQ ID NO: 3308 - DNA, 36 bp, Homo sapiens
aggtagctgggactacaggtttgtgccactatgctt

SEQ ID NO: 3309 - DNA, 73 bp, Homo sapiens
cactttttccggcatcccaatattacaacttattggacagttttcactgttggcagctggctttgggttattt

SEQ ID NO: 3310 - DNA, 36 bp, Homo sapiens
aacatgctggcattacaggtgtggatgtgtgggggc

SEQ ID NO: 3311 - DNA, 500 bp, Homo sapiens
ttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgt

SEQ ID NO: 3312 - DNA, 41 bp, Homo sapiens
gaattggagcaaaaagaggttgattacagcggcctcagggt

SEQ ID NO: 3313 - DNA, 36 bp, Homo sapiens
gatgcttatatgcagcagtatcaacatgcaacacag

SEQ ID NO: 3314 - DNA, 36 bp, Homo sapiens
cattgcatggactatctgatgaagaatgccgactac

SEQ ID NO: 3315 - DNA, 36 bp, Homo sapiens
catctcactctagcccaggtagtccaaagaagcaga

SEQ ID NO: 3316 - DNA, 36 bp, Homo sapiens
tgatgaggaccgacagagaatgaacaaattaatgga

SEQ ID NO: 3317 - DNA, 342 bp, Homo sapiens
gcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaa

SEQ ID NO: 3318 - DNA, 36 bp, Homo sapiens
tgtttttgcttctccaaggaaaatggcagctcccga

SEQ ID NO: 3319 - DNA, 36 bp, Homo sapiens; identical to SEQ ID NO: 3316

SEQ ID NO: 3320 - DNA, 456 bp, Homo sapiens
ggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcagg

SEQ ID NO: 3321 - DNA, 500 bp, Homo sapiens
ggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaatt

SEQ ID NO: 3322 - DNA, 500 bp, Homo sapiens
tgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcag

SEQ ID NO: 3323 - DNA, 500 bp, Homo sapiens
gggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggat

SEQ ID NO: 3324 - DNA, 500 bp, Homo sapiens
cttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcag

SEQ ID NO: 3325 - DNA, 36 bp, Homo sapiens
gtgattcacccgcctcagccttccaaagtgctggga

SEQ ID NO: 3326 - DNA, 373 bp, Homo sapiens
ttataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatga

SEQ ID NO: 3327 - DNA, 500 bp, Homo sapiens
ctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaa

SEQ ID NO: 3328 - DNA, 500 bp, Homo sapiens
ggaggcagtagagcctgaagtcttgcaggactcactggatagatgttattcaactccttccagttgtcttgaacagcctgactcctgcctgccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggggaagaagatcaaaacccaccatgccccaggctcagcggcatgctgatggaagtggaagagcctgaagtcttgcaggactcactggatagatgttattcgactccgtcaatgtactttgaactacctgactcattccagcactacagaagtgtgttttactcatttgaggaacagcacatcagcttcgcccttgacgtggacaataggtttcttactttgatgggaacaagtctccacctggtcttccagatgggagtcatat

SEQ ID NO: 3329 - DNA, 36 bp, Homo sapiens
attcaacatgtttcccaggcaatctgaaggcaaatc

SEQ ID NO: 3330 - DNA, 500 bp, Homo sapiens
ccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctga

SEQ ID NO: 3331 - DNA, 58 bp, Homo sapiens
gtcgcagtccagctcccagacggagattggcagcctcaacagcaaaggcagcctcgga

SEQ ID NO: 3332 - DNA, 500 bp, Homo sapiens
caggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattgg

SEQ ID NO: 3333 - DNA, 36 bp, Homo sapiens
tcagggtcgggcttccaggtgagagcttagagccct

SEQ ID NO: 3334 - DNA, 78 bp, Homo sapiens
ttgttgggaaagggctttcgagggggtgggggccgatggaaggctctgttgggccggcaccaggcgaggctcaaggct

SEQ ID NO: 3335 - DNA, 500 bp, Homo sapiens
ggtctgtcccaggccctgggcctcgtgcagctccacgctgccccctggtgtgcgctacggcgaggtgcagcgcgtccgccccgcgccctctgccgacccgcagttctgtgtgcggctccgcattgcgcctggctcgaaacggcgaccactgccaggttcccaaaatactggataaaatatatatatatatatagtgtttgtatatatatttaagatatgtaaaatatatgaatatatataaatatataattatatatgaatatattacatattcatgtatacgtaatatattcgtatattttataaacattttttatattttattatataaaatataaatatttaatttttttttatgagacggagtctcgctctgtgacccaggctggagtgcagtggtgcaatctcagctcactgcaacctccacctcccaggttcaagcaattctcctcagtctcctgagtagctgggattacaggcgcctgccaccacgcttggct

SEQ ID NO: 3336 - DNA, 36 bp, Homo sapiens
gcaggcagaaagggacaagcgaatgcgagaggagca

SEQ ID NO: 3337 - DNA, 500 bp, Homo sapiens
aagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcct

SEQ ID NO: 3338 - DNA, 36 bp, Homo sapiens
tttgatacgtccctgcagtcctgcccctgtggattt

SEQ ID NO: 3339 - DNA, 36 bp, Homo sapiens
atgaaacgtgctctccagcagaagtagaaagtaatg

SEQ ID NO: 3340 - DNA, 36 bp, Homo sapiens
ataccaccccaagaattgaaaaccagacaaacaaaa

SEQ ID NO: 3341 - DNA, 500 bp, Homo sapiens
tctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctga

SEQ ID NO: 3342 - DNA, 36 bp, Homo sapiens
ctggtgattccacctctggtgatcccacctctagcg

SEQ ID NO: 3343 - DNA, 322 bp, Homo sapiens
agccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggc

SEQ ID NO: 3344 - DNA, 36 bp, Homo sapiens
tgcctctggtgatgcaacctctggtgatgccccttc

SEQ ID NO: 3345 - DNA, 266 bp, Homo sapiens
tggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctgg

SEQ ID NO: 3346 - DNA, 30 bp, Homo sapiens
agccctcctctagtgatgctgcctctggtg

SEQ ID NO: 3347 - DNA, 80 bp, Homo sapiens
attgttgatgtatactagttgatttgtgctctgagtgttgtctttaatttaactttatttatggcctgtattagtatagt

SEQ ID NO: 3348 - DNA, 102 bp, Homo sapiens
gaagaaaaattgtgtgcgctgcagtgtgctgtatttgataagactttggcagaattgaaaacacgagtggaaaagattgaatgtaacaagaggcataaaaca

SEQ ID NO: 3349 - DNA, 171 bp, Homo sapiens
ggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgcc

SEQ ID NO: 3350 - DNA, 76 bp, Homo sapiens
agacggggtttcaccatggtgaccaggctggtcttgaactcctgacctcaagtgatccgcccgcctcggcctccca

SEQ ID NO: 3351 - DNA, 26 bp, Homo sapiens
atcgtggcagtattgtggacactgag

SEQ ID NO: 3352 - DNA, 500 bp, Homo sapiens
ctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcatctctgctgcctggcaagctc

SEQ ID NO: 3353 - DNA, 500 bp, Homo sapiens
ccaagctgaccgacgaggacttctcgccatttggctctggaggtggcctgttcagtgggggcaaggggctatttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaa

SEQ ID NO: 3354 - DNA, 36 bp, Homo sapiens
ctgaggatgaagaagatgatagggatgaggaagaaa

SEQ ID NO: 3355 - DNA, 36 bp, Homo sapiens
caaacactaccaaatcagaatcagtcgcaaacccag

SEQ ID NO: 3356 - DNA, 90 bp, Homo sapiens
agccatcactccttggagcatctcctaccatttatacacagcaaactgcattggcagcagcaggccttaccacacaaactccagcaaact

SEQ ID NO: 3357 - DNA, 56 bp, Homo sapiens
acaagccttagcctgtctactcctcagccaacagcacaaataactgtatcatatcc

SEQ ID NO: 3358 - DNA, 500 bp, Homo sapiens
atccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatccccca

SEQ ID NO: 3359 - DNA, 36 bp, Homo sapiens
ctactcctcagccaacagcacaaataactgtatcat

SEQ ID NO: 3360 - DNA, 79 bp, Homo sapiens
cccccaagtaggtgacagagtattggttgaagctacttataatcctaatatgccttttaaatggaatgcacagagaatt

SEQ ID NO: 3361 - DNA, 157 bp, Homo sapiens
ccattactgaagactcctcctgctgtacttcagccaattgcaccacagacaacatttggtgttcagactcagccccagccccagtcactgctgcaggcacagatttcagcagcttctattacaccactattgcagactcaaccacagcccttattac

SEQ ID NO: 3362 - DNA, 500 bp, Homo sapiens
aaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattac

SEQ ID NO: 3363 - DNA, 500 bp, Homo sapiens
cttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggtta

SEQ ID NO: 3364 - DNA, 76 bp, Homo sapiens
gatgattctaaagatgatgatgaaactgaagaagataacaatcaagatgaatatgaccctatggaagcagaagaag

SEQ ID NO: 3365 - DNA, 36 bp, Homo sapiens
ttgtttcctcacctctaggcacagaccccacaggct

SEQ ID NO: 3366 - DNA, 500 bp, Homo sapiens
cctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactaga

SEQ ID NO: 3367 - DNA, 36 bp, Homo sapiens
gactctgatgcatatagggacaaacagcatattcta

SEQ ID NO: 3368 - DNA, 36 bp, Homo sapiens
tctttttcttctcttcagggtgtacaggagagagtt

SEQ ID NO: 3369 - DNA, 235 bp, Homo sapiens
attcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctcc

SEQ ID NO: 3370 - DNA, 500 bp, Homo sapiens
cctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgt

SEQ ID NO: 3371 - DNA, 500 bp, Homo sapiens; identical to SEQ ID NO: 3370

SEQ ID NO: 3372 - DNA, 500 bp, Homo sapiens
ctgccgcataggactgctgggaggattcactcagttcacttacgtcaggatcatccatatggctgtccctcacctctgcatcttgtcccactggaaggtcttcaggggcagtaatacacatggagctgtcatcacccctgataacaatgccttctggaatacctcctgaaggctctgcctaaggctgttctacagttaacttttgttttaataagtagaaaaaaataagacctgatgtggtggctcatgcctataatcccagcaagtttgccaggccaaggcgggtggatcacctgaggttaggagttcaagaccagctgggccaacatagtgaaaccgcatctctactaaaaatacaaaaattagccaggcatggtggtgagagcttgtaatcccagctacttgggaggctgaggcagtagaatcacttgaacccaggaggtggaggttgcagtgagctgagatcgtgccattgcattccagcctgggtgacagaccga

SEQ ID NO: 3373 - DNA, 277 bp, Homo sapiens
gcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttt

SEQ ID NO: 3374 - DNA, 36 bp, Homo sapiens
aaggatgagtatgagaggaatcagatgggtgactca

SEQ ID NO: 3375 - DNA, 36 bp, Homo sapiens
tccgggtcacaggataagtctgctccatctggacac

SEQ ID NO: 3376 - DNA, 500 bp, Homo sapiens
gggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgac

SEQ ID NO: 3377 - DNA, 431 bp, Homo sapiens
acggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccc

SEQ ID NO: 3378 - DNA, 500 bp, Homo sapiens
aatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgca

SEQ ID NO: 3379 - DNA, 500 bp, Homo sapiens
aaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggt

SEQ ID NO: 3380 - DNA, 500 bp, Homo sapiens
acaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccc

SEQ ID NO: 3381 - DNA, 36 bp, Homo sapiens
gcttctcctggcctgagcttcgcccaaagtcagacg

SEQ ID NO: 3382 - DNA, 36 bp, Homo sapiens
ttttatgtccccctttagcgcattggatattcattt

SEQ ID NO: 3383 - DNA, 36 bp, Homo sapiens
aaagccagtatggatgtggagaatcctgattattct

SEQ ID NO: 3384 - DNA, 36 bp, Homo sapiens
atttcattgcagagcgaggtgaccaaactgaggaag

SEQ ID NO: 3385 - DNA, 36 bp, Homo sapiens
acaataaaatccagaatgccccatccaggaagtcgg

SEQ ID NO: 3386 - DNA, 36 bp, Homo sapiens
caactattgagccacacagtaagagcatctcttagg

SEQ ID NO: 3387 - DNA, 36 bp, Homo sapiens
tgctggaaacaagggcagccagtgatggtgtctgga

SEQ ID NO: 3388 - DNA, 36 bp, Homo sapiens
gtacagtggcctgcaataacgtacaaacctctgttg

SEQ ID NO: 3389 - DNA, 36 bp, Homo sapiens
caagtcaactgtgaggagattccagcactgaaaatt

SEQ ID NO: 3390 - DNA, 36 bp, Homo sapiens
gcaaaatcttgctctgaggcctctcccagtatgtgt

SEQ ID NO: 3391 - DNA, 178 bp, Homo sapiens
aaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaagg

SEQ ID NO: 3392 - DNA, 500 bp, Homo sapiens
acattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaat

SEQ ID NO: 3393 - DNA, 294 bp, Homo sapiens
gtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaat

SEQ ID NO: 3394 - DNA, 67 bp, Homo sapiens
ctttctcttacggataatcagattgtcagtaaagaatttcaagctttgattgtgaagcatttagatg

SEQ ID NO: 3395 - DNA, 89 bp, Homo sapiens
gttcagaagtaaaaatttatagcttggacccatctactcagtggttttcagcaaccgttataaatggaaacccagcatcaaaaactctt

SEQ ID NO: 3396 - DNA, 53 bp, Homo sapiens
gagctgtaaaacgcaagtcttctgagaataatggaaccctggtttccaaacaa

SEQ ID NO: 3397 - DNA, 500 bp, Homo sapiens
tacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaa

SEQ ID NO: 3398 - DNA, 117 bp, Homo sapiens
gagctgtcaaaggtgttcgagaaatgtgtgatgtgtgcgacaccaccatcttcaacctgcactgggtgtgtcctcggtgtgggtttggagtatgtgtggactgctaccggatgaaga

SEQ ID NO: 3399 - DNA, 500 bp, Homo sapiens
tctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaac

SEQ ID NO: 3400 - DNA, 160 bp, Homo sapiens
aaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatg

SEQ ID NO: 3401 - DNA, 500 bp, Homo sapiens
ttggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctca

SEQ ID NO: 3402 - DNA, 500 bp, Homo sapiens
aatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaa

SEQ ID NO: 3403 - DNA, 500 bp, Homo sapiens
gtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtcct

SEQ ID NO: 3404 - DNA, 136 bp, Homo sapiens
gtgcatcataaattgaactctgaactttggaaacctgaatccttcaggaaagagtttggtgagcaggaagtagacctagttaattgtaggaccaatgaaatcatcacaggagccacagtaggagacttctgggatg

SEQ ID NO: 3405 - DNA, 500 bp, Homo sapiens
ttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttag

SEQ ID NO: 3406 - DNA, 36 bp, Homo sapiens
tgttctcctcagagcctgtcatccgtccttggctca

SEQ ID NO: 3407 - DNA, 36 bp, Homo sapiens
gaagctaaagttaagcagcttatggaagtgacaggg

SEQ ID NO: 3408 - DNA, 134 bp, Homo sapiens
gaaatgcctggttcagcagatgtcacaggattaaatgtgcagtttggggctctggaatttgggtcagaaccttctctctctgaatttggatcagctccaagcagtgaaaatagtaatcagattcccatcagctt

SEQ ID NO: 3409 - DNA, 141 bp, Homo sapiens
gcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcgg

SEQ ID NO: 3410 - DNA, 193 bp, Homo sapiens
tccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcct

SEQ ID NO: 3411 - DNA, 500 bp, Homo sapiens
tttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcag

SEQ ID NO: 3412 - DNA, 99 bp, Homo sapiens
catctcagctcaccgcgacctctgcctcctggattcaagtgattctccaacctcagcctcccgagtagctgggactatagcagtgcaccaccatgtatg

SEQ ID NO: 3413 - DNA, 214 bp, Homo sapiens
aggctggagtgcaatggcacaatctcggctcactgcaacctccacctcccaggttcaagcaattctcctgcctcagcctcctgagtagctgggattacaggcacctgccaccatgcccggctaatttttttgtatttttagtagagacggggtttcaccatgttggccaggctggtcgcgaactcctgacctcaggtgatccacccgcctcagc

SEQ ID NO: 3414 - DNA, 36 bp, Homo sapiens
tgttggaggtccaaaaagttcccattctgtgatggg

SEQ ID NO: 3415 - DNA, 36 bp, Homo sapiens
ccagttccagcgtacgagcccactccatgctgggaa

SEQ ID NO: 3416 - DNA, 326 bp, Homo sapiens
ctttcacatttatggcatttgtcttgttgaaacatcgtggtgcacatttgtttaaacaaaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatcta

SEQ ID NO: 3417 - DNA, 36 bp, Homo sapiens
agcttgccaaagggccagcacgcttcctgggctgtt

SEQ ID NO: 3418 - DNA, 36 bp, Homo sapiens
ctgttctgtcctccgcagagtgagcctcgcagctgg

SEQ ID NO: 3419 - DNA, 500 bp, Homo sapiens
gcccctccctccgcgcggggacccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctac

SEQ ID NO: 3420 - DNA, 36 bp, Homo sapiens
taatgacatgcttgtcaggtgagtgtgcttttccct

SEQ ID NO: 3421 - DNA, 415 bp, Homo sapiens
ctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatg

SEQ ID NO: 3422 - DNA, 500 bp, Homo sapiens
tcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaaca

SEQ ID NO: 3423 - DNA, 36 bp, Homo sapiens
tcgagatgaagtagacagcctgatgtgtgaaaaaag

SEQ ID NO: 3424 - DNA, 150 bp, Homo sapiens
ttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaa

SEQ ID NO: 3425 - DNA, 500 bp, Homo sapiens
tgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctg

SEQ ID NO: 3426 - DNA, 500 bp, Homo sapiens
gcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgtt

SEQ ID NO: 3427 - DNA, 87 bp, Homo sapiens
tcagcaacaggcagccaggagctctgaggctcacagctggcagtctagttctactcagtctctacttgagaaattctttctttggaa

SEQ ID NO: 3428 - DNA, 138 bp, Homo sapiens
aagaaaaccaatcaatttttcgcaataaaggccttaaagaaagatgtggtcttgatggacgatgatgttgagtgcacgatggtagagaagagagttctttccttggcctgggagcatccgtttctgacgcacatgttt

SEQ ID NO: 3429 - DNA, 36 bp, Homo sapiens
tgacctcaggtgatccacccgcctcagcctcccaaa

SEQ ID NO: 3430 - DNA, 36 bp, Homo sapiens
cgagttcaagcgattctcccgcctcagcctcccaaa

SEQ ID NO: 3431 - DNA, 36 bp, Homo sapiens
tgaaccagaagttcaatggactgcctcaacttcagt

SEQ ID NO: 3432 - DNA, 36 bp, Homo sapiens
tttgttttctcttcatagcctggttcacctggatct

SEQ ID NO: 3433 - DNA, 36 bp, Homo sapiens
tttaccagacatctcatgggtttgtggatgcactta

SEQ ID NO: 3434 - DNA, 79 bp, Homo sapiens
tagccctgtggtagttgagaaatccaacagttatccccaccagttatataccagcagctcacatcattcacacagttac

SEQ ID NO: 3435 - DNA, 500 bp, Homo sapiens
gccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattga

SEQ ID NO: 3436 - DNA, 213 bp, Homo sapiens
gatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagag

SEQ ID NO: 3437 - DNA, 213 bp, Homo sapiens
ggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctc

SEQ ID NO: 3438 - DNA, 215 bp, Homo sapiens
aaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccagga

SEQ ID NO: 3439 - DNA, 45 bp, Homo sapiens
ctgcatggggattgataggcagcatattcctgatacatatctatg

SEQ ID NO: 3440 - DNA, 500 bp, Homo sapiens
aggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcaga

SEQ ID NO: 3441 - DNA, 500 bp, Homo sapiens
gcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaa

SEQ ID NO: 3442 - DNA, 500 bp, Homo sapiens
ggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgt

SEQ ID NO: 3443 - DNA, 459 bp, Homo sapiens
gtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaaga

SEQ ID NO: 3444 - DNA, 36 bp, Homo sapiens
gcagccccgcggtgctggcattacagacatctttag

SEQ ID NO: 3445 - DNA, 36 bp, Homo sapiens
tcactcaacagtattgaatttcgtgaatgtagagaa

SEQ ID NO: 3446 - DNA, 36 bp, Homo sapiens
aggaagagaatgcatcagttattgattctgcagaac

SEQ ID NO: 3447 - DNA, 36 bp, Homo sapiens
taaggagtttgtggcaaggattaaaagtaagttgga

SEQ ID NO: 3448 - DNA, 36 bp, Homo sapiens
gccgggtttgatgagcgggtgacagtcatggcgtct

SEQ ID NO: 3449 - DNA, 36 bp, Homo sapiens
ctaagtccatggaagaagatccccagacttcaaggg

SEQ ID NO: 3450 - DNA, 373 bp, Homo sapiens
tcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaaga

SEQ ID NO: 3451 - DNA, 304 bp, Homo sapiens
agttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaag

SEQ ID NO: 3452 - DNA, 500 bp, Homo sapiens
ccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcag

SEQ ID NO: 3453 - DNA, 500 bp, Homo sapiens
tatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctca

SEQ ID NO: 3454 - DNA, 39 bp, Homo sapiens
tatacaaaagatagagctgctaaatgtaaaattccagcc

SEQ ID NO: 3455 - DNA, 438 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagcc

SEQ ID NO: 3456 - DNA, 500 bp, Homo sapiens
gagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaaga

SEQ ID NO: 3457 - DNA, 64 bp, Homo sapiens
gagcccaaactacctgttctggcaggatgtctgaaggggttgtcctcacttctgtgcaacttca

SEQ ID NO: 3458 - DNA, 500 bp, Homo sapiens
agatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttc

SEQ ID NO: 3459 - DNA, 122 bp, Homo sapiens
ccctgcatgcatctcagtttagcacctgccttctggacaactacgtgtctctatttgaagtcttgttaaagtggtgtgcccacacaaatgtagaattgaaaaaagctgcactttcagccctg

SEQ ID NO: 3460 - DNA, 500 bp, Homo sapiens
gagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctg

SEQ ID NO: 3461 - DNA, 500 bp, Homo sapiens
cttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtgga

SEQ ID NO: 3462 - DNA, 500 bp, Homo sapiens
ccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctga

SEQ ID NO: 3463 - DNA, 497 bp, Homo sapiens
tttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaact

SEQ ID NO: 3464 - DNA, 500 bp, Homo sapiens
tgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattca

SEQ ID NO: 3465 - DNA, 154 bp, Homo sapiens
aatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgata

SEQ ID NO: 3466 - DNA, 500 bp, Homo sapiens
cagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatac

SEQ ID NO: 3467 - DNA, 500 bp, Homo sapiens
tgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaac

SEQ ID NO: 3468 - DNA, 125 bp, Homo sapiens
tgcaggcgtatccagcacttgtggtggagaaaatgttgaaagctttaaaattaaattccaatgaagccagattgaagtttcctagattacttcagattatagaacggtatccagaggagactttg

SEQ ID NO: 3469 - DNA, 500 bp, Homo sapiens
tggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgactt

SEQ ID NO: 3470 - DNA, 176 bp, Homo sapiens
tggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaa

SEQ ID NO: 3471 - DNA, 500 bp, Homo sapiens
gctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttg

SEQ ID NO: 3472 - DNA, 500 bp, Homo sapiens
ctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaa

SEQ ID NO: 3473 - DNA, 108 bp, Homo sapiens
agagctgaactagcaaaaacccctgtaaataaaaaaaacattgaaaaaatgtatgaaagaatgtatgcagccttgggtgacccaaaggctccaggcctgggggccttt

SEQ ID NO: 3474 - DNA, 36 bp, Homo sapiens
aggctgggacagcctcaggaggggaggaggccggga

SEQ ID NO: 3475 - DNA, 36 bp, Homo sapiens
aaagatgtgggtgtgaagacctcagaaagtactact

SEQ ID NO: 3476 - DNA, 36 bp, Homo sapiens
tgtaaaccctatttccaagctccctgatggattttc

SEQ ID NO: 3477 - DNA, 230 bp, Homo sapiens
tgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgag

SEQ ID NO: 3478 - DNA, 281 bp, Homo sapiens
ttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcaggga

SEQ ID NO: 3479 - DNA, 479 bp, Homo sapiens
ttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcag

SEQ ID NO: 3480 - DNA, 500 bp, Homo sapiens
atgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaa

SEQ ID NO: 3481 - DNA, 500 bp, Homo sapiens
acagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttaca

SEQ ID NO: 3482 - DNA, 500 bp, Homo sapiens
actacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaac

SEQ ID NO: 3483 - DNA, 36 bp, Homo sapiens
aagctatgagcaatacaggcagtttcagcgtcgaaa

SEQ ID NO: 3484 - DNA, 411 bp, Homo sapiens
ttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcgga

SEQ ID NO: 3485 - DNA, 500 bp, Homo sapiens
ggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttccc

SEQ ID NO: 3486 - DNA, 500 bp, Homo sapiens
gcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactct

SEQ ID NO: 3487 - DNA, 36 bp, Homo sapiens
tctccttccccaacatagagacctcattaagaaact

SEQ ID NO: 3488 - DNA, 500 bp, Homo sapiens
gctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatccttta

SEQ ID NO: 3489 - DNA, 36 bp, Homo sapiens
tatgtctaccggaagcagaaaaagaagatggagaat

SEQ ID NO: 3490 - DNA, 500 bp, Homo sapiens
ttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggac

SEQ ID NO: 3491 - DNA, 36 bp, Homo sapiens
tgttgaaagaacccacaggtgcatttcacagcactc

SEQ ID NO: 3492 - DNA, 500 bp, Homo sapiens
cagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccacc

SEQ ID NO: 3493 - DNA, 45 bp, Homo sapiens
ggattacctggcagtggaaagacacatgttgcaaaacttattcga

SEQ ID NO: 3494 - DNA, 45 bp, Homo sapiens
attgttgttataatgagaggattacctggcagtggaaagacacat

SEQ ID NO: 3495 - DNA, 500 bp, Homo sapiens
gatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgcc

SEQ ID NO: 3496 - DNA, 500 bp, Homo sapiens
caactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacag

SEQ ID NO: 3497 - DNA, 500 bp, Homo sapiens
tcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaag

SEQ ID NO: 3498 - DNA, 36 bp, Homo sapiens
atttatctgagcgttctgagcagaatcggagatcag

SEQ ID NO: 3499 - DNA, 500 bp, Homo sapiens
ccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagc

SEQ ID NO: 3500 - DNA, 122 bp, Homo sapiens
tttgctaaggacattgtgactctccagagagcaacagtgatggctctagaatgtctaggaaaaagaagggcttaatgtcaggagtctgcttggggcacacaacactagaagatgtccttctg

SEQ ID NO: 3501 - DNA, 36 bp, Homo sapiens
tggatctgccagcaaagggatggaatgtgggatggt

SEQ ID NO: 3502 - DNA, 36 bp, Homo sapiens
ggactagcgaacccggagcacgacatcataaaataa

SEQ ID NO: 3503 - DNA, 61 bp, Homo sapiens
gtggaagctgtgatgctttgggaaactggaatcctcaaaatgctgtggctcttcttccaga

SEQ ID NO: 3504 - DNA, 340 bp, Homo sapiens
agtttggtctggagcagctgaaaccggtttgagcgtggctgcttcctgccgctcgacgccgcggcaggccgcctgggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccaga

SEQ ID NO: 3505 - DNA, 433 bp, Homo sapiens
aggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagagggg

SEQ ID NO: 3506 - DNA, 36 bp, Homo sapiens
cccgagtagctgggattacaggtgtctgcaattgaa

SEQ ID NO: 3507 - DNA, 79 bp, Homo sapiens
aggctggagtgcagtggcacaatcttggctcactgcaacctctgcctcccgggttcaagcaattctcctgcctcagcct

SEQ ID NO: 3508 - DNA, 36 bp, Homo sapiens
agatggattcagaaacaggcaacagcgagtgaccaa

SEQ ID NO: 3509 - DNA, 36 bp, Homo sapiens
caaggacgtccgcagcaggagctcccgcccagcctg

SEQ ID NO: 3510 - DNA, 64 bp, Homo sapiens
acctaatctgggagcctgcaagtgacaacagcctttgcggtccttagacagcttggcctggagg

SEQ ID NO: 3511 - DNA, 362 bp, Homo sapiens
tgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaatt

SEQ ID NO: 3512 - DNA, 189 bp, Homo sapiens
aagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattt

SEQ ID NO: 3513 - DNA, 46 bp, Homo sapiens
caagtgacaacagcctttgcggtccttagacagcttggcctggagg

SEQ ID NO: 3514 - DNA, 500 bp, Homo sapiens
aagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggt

SEQ ID NO: 3515 - DNA, 298 bp, Homo sapiens
accataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcag

SEQ ID NO: 3516 - DNA, 30 bp, Homo sapiens
cgagcagagaatcagaatgacaatagagaa

SEQ ID NO: 3517 - DNA, 36 bp, Homo sapiens
ttctccatctccttgcaggtaggttttgtcatcata

SEQ ID NO: 3518 - DNA, 147 bp, Homo sapiens
agaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagc

SEQ ID NO: 3519 - DNA, 26 bp, Homo sapiens
tcgagacatgtaagcagcatcatgga

SEQ ID NO: 3520 - DNA, 437 bp, Homo sapiens
taacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 3521 - DNA, 55 bp, Homo sapiens
tgtatctgagcaggttgctccacaggtagctctaggagggctggcaacttagagg

SEQ ID NO: 3522 - DNA, 61 bp, Homo sapiens
ttcacccccactgaaaaagatgagtatgcctgccgtgtgaaccatgtgactttgtcacagc

SEQ ID NO: 3523 - DNA, 36 bp, Homo sapiens
tagctctaggagggctggcaacttagaggtggggag

SEQ ID NO: 3524 - DNA, 36 bp, Homo sapiens
ggagggctggcaacttagaggtggggagcagagaat

SEQ ID NO: 3525 - DNA, 194 bp, Homo sapiens
ctccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacact

SEQ ID NO: 3526 - DNA, 142 bp, Homo sapiens
ctccatgtttgatgtatctgagcaggttgctccacaggtagctctaggagggctggcaacttagaggtggggagcagagaattctcttatccaacatcaacatcttggtcagatttgaactcttcaatctcttgcactcaaa

SEQ ID NO: 3527 - DNA, 36 bp, Homo sapiens
ctgcccatagcctgcctcgggcctccacctgcggcc

SEQ ID NO: 3528 - DNA, 36 bp, Homo sapiens
tgtgtttttcctttgcagtctcgaagatatgactcc

SEQ ID NO: 3529 - DNA, 36 bp, Homo sapiens
attggaaataatagcgctgcagctgtgtcaatgttg

SEQ ID NO: 3530 - DNA, 26 bp, Homo sapiens
ggatggaaggccacatgcattggaaa

SEQ ID NO: 3531 - DNA, 36 bp, Homo sapiens
acctgaccctgcctcagcatcccccagtgctactgc

SEQ ID NO: 3532 - DNA, 36 bp, Homo sapiens
gggcttcctggcctccagcaccctctccaggcctca

SEQ ID NO: 3533 - DNA, 500 bp, Homo sapiens
attatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgc

SEQ ID NO: 3534 - DNA, 127 bp, Homo sapiens
gtaacggtcctcagcgcaagggtcatttcgtcgctgggaagggacggccctcgcccgcggtgatggtggttagcaagatgaacaaagatgcgcagatgagagcagcgattaaccaaaagttgataga

SEQ ID NO: 3535 - DNA, 85 bp, Homo sapiens
ccatgttggtcaggccggtctcaaactcctgacctcaaatgatctacctgcctcggcctcccaaagtgctgggattacatcatga

SEQ ID NO: 3536 - DNA, 500 bp, Homo sapiens
taggatggagctaagagggaagtggggaaggtggactctctgatagcaggtgggcagaggagggcttgtcttgctttgggtcacagttggggctgggtcccttcttatttatttatttattttgagatggagtcttgctttgttgcccaggctggagtacagtggtgtgatctccgctcactgcaacctttgcctcccgggttcaagcaattctcctgccttagcctcttgagtagctgggattacaggcactcaccaccacgcctggctaatgtttgtatttttagtagagacggggtttcaccatgttggccaggctggtcttgaactcctgacctcaagtgatccacctgcctcagcttcccaaagtgttgggattacaggcgtgagccccggcgccctgccccttcttcttttttttttttttcttgagagaaggtctcactctgtcaccaaggctggagtgcagtggtaccatctcggctcaatgcaacttctgc

SEQ ID NO: 3537 - DNA, 309 bp, Homo sapiens
agtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaacca

SEQ ID NO: 3538 - DNA, 26 bp, Homo sapiens
tggtggtcatggtcctggaggtggca

SEQ ID NO: 3539 - DNA, 87 bp, Homo sapiens
agtggtggaggaacttccggcagcggcagctcaagtggccaaggcaagatgggtcaaagtcagagtggtggtcatggtcctggaggt

SEQ ID NO: 3540 - DNA, 184 bp, Homo sapiens
agtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctg

SEQ ID NO: 3541 - DNA, 36 bp, Homo sapiens
gctgtgtgtgtggaggcgggcatgatcgcactgcgc

SEQ ID NO: 3542 - DNA, 83 bp, Homo sapiens
caggctggagtgcagtggcacaatcttgactcgctgcagtctccacctccaggattcaagcgattcccctgcctcagtctccc

SEQ ID NO: 3543 - DNA, 500 bp, Homo sapiens
aagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgc

SEQ ID NO: 3544 - DNA, 76 bp, Homo sapiens
agatcctgagctggaggcccagggagatgacatggtttgtgatgatccggaggctggggagatgacatcagaaaac

SEQ ID NO: 3545 - DNA, 500 bp, Homo sapiens
gagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgag

SEQ ID NO: 3546 - DNA, 36 bp, Homo sapiens
gaggagaaaatggaagtggatgaggcagagaaaaag

SEQ ID NO: 3547 - DNA, 36 bp, Homo sapiens
tggttcttttcatttcagtgactcgatggaaacaga

SEQ ID NO: 3548 - DNA, 500 bp, Homo sapiens
gaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttcc

SEQ ID NO: 3549 - DNA, 500 bp, Homo sapiens
cccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtaga

SEQ ID NO: 3550 - DNA, 500 bp, Homo sapiens
agtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagttt

SEQ ID NO: 3551 - DNA, 500 bp, Homo sapiens
attgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaa

SEQ ID NO: 3552 - DNA, 36 bp, Homo sapiens
ctgatgggctgtttgacggtgagtctgcaccctgtc

SEQ ID NO: 3553 - DNA, 36 bp, Homo sapiens
ccttggctgcccaaagtgctgggattacaggcatga

SEQ ID NO: 3554 - DNA, 36 bp, Homo sapiens
gaaaagcagactcgtactgtgagtagtttacagggg

SEQ ID NO: 3555 - DNA, 36 bp, Homo sapiens
tctacagaggaaggtgaaaatattagaataatggcc

SEQ ID NO: 3556 - DNA, 421 bp, Homo sapiens
cgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgag

SEQ ID NO: 3557 - DNA, 500 bp, Homo sapiens
aaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggag

SEQ ID NO: 3558 - DNA, 36 bp, Homo sapiens
cctgcctcagcctcctgagtaagtgggaccacaggc

SEQ ID NO: 3559 - DNA, 36 bp, Homo sapiens
tttggggtagcaatccaggagaaggtgctggagagg

SEQ ID NO: 3560 - DNA, 36 bp, Homo sapiens
atgctggctacaactaataaaaccgaaaaaagtgaa

SEQ ID NO: 3561 - DNA, 500 bp, Homo sapiens
ggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaa

SEQ ID NO: 3562 - DNA, 80 bp, Homo sapiens
gatttatttaatggggatgtgttcaaggcaagaccgaattcagaaggatatcgacgtcgtgatccagaagtccagagctg

SEQ ID NO: 3563 - DNA, 500 bp, Homo sapiens
acggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaa

SEQ ID NO: 3564 - DNA, 500 bp, Homo sapiens
tcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgacc

SEQ ID NO: 3565 - DNA, 36 bp, Homo sapiens
tgggttcaagcagttctcctgcctcagcctcctgag

SEQ ID NO: 3566 - DNA, 36 bp, Homo sapiens
caggttcaagcaattctcctgcctcagccacctgaa

SEQ ID NO: 3567 - DNA, 36 bp, Homo sapiens
tgggttcaagcagttctcctgcctcagccacctgaa

SEQ ID NO: 3568 - DNA, 500 bp, Homo sapiens
ggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcg

SEQ ID NO: 3569 - DNA, 500 bp, Homo sapiens
ggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttga

SEQ ID NO: 3570 - DNA, 36 bp, Homo sapiens
ggccggctggcccggcagccccccaaggaagagaag

SEQ ID NO: 3571 - DNA, 36 bp, Homo sapiens
ggccggctggcccggcaggtggagcccccgaggagg

SEQ ID NO: 3572 - DNA, 135 bp, Homo sapiens
tcagctaccaataccacccttccacacatgttgatgtctcaacgtgttattgcaccaaacccagcccagctacagggtcagcggggcccgcctaagcctggccttgtacgcaccacaacacccaacatgaatccc

SEQ ID NO: 3573 - DNA, 36 bp, Homo sapiens
gctgcttgggaggctgaggcaggagaatcacttgaa

SEQ ID NO: 3574 - DNA, 144 bp, Homo sapiens
tacaggcacgcaccaccatgcctggctaattttttgtatttttagtagaaacagggtttcaccatgttagccaggctgacctcaaactcctgacctcaggtgatccgcccgcctccacctcccagggtgctgggattacaggtg

SEQ ID NO: 3575 - DNA, 36 bp, Homo sapiens
cgattctcctgcctcagcctcttcaagcttttttac

SEQ ID NO: 3576 - DNA, 36 bp, Homo sapiens
acagtgccacctccacaggtcccaccacatcaaccg

SEQ ID NO: 3577 - DNA, 500 bp, Homo sapiens
aaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactcc

SEQ ID NO: 3578 - DNA, 36 bp, Homo sapiens
acacaccaagaactggaggccacagctgctggtgct

SEQ ID NO: 3579 - DNA, 485 bp, Homo sapiens
gtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgc

SEQ ID NO: 3580 - DNA, 36 bp, Homo sapiens
gaattcacagatgtggaagaagatccctcctgcggc

SEQ ID NO: 3581 - DNA, 137 bp, Homo sapiens
cagacccactggagccaccgtcacttcctgctgagaggccagggccccccacacctgctgcggcccacagcatcccctacaacagctgcagagagaaggagccaagttaccccatgcctgtccaggagacccaggcg

SEQ ID NO: 3582 - DNA, 36 bp, Homo sapiens
acactgaaggctgcaatggttcagtttgatcgttat

SEQ ID NO: 3583 - DNA, 36 bp, Homo sapiens
tgctccatggcgagctggataccatgtttgtgtgga

SEQ ID NO: 3584 - DNA, 36 bp, Homo sapiens
atactgccaaaaatccaagtatgccctttaaagcat

SEQ ID NO: 3585 - DNA, 500 bp, Homo sapiens
gatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccactattgggcttattctctgctctatagttgtgaaatgaagagtgaaaacaaatttgtttgactattttaaaattatattagaccttaagctgttttagcaagcattaaagcaaatgtatggctgccttttaaaatatttgat

SEQ ID NO: 3586 - DNA, 36 bp, Homo sapiens
ctctcctcttgcccccaggacgcccgaacgcagcgc

SEQ ID NO: 3587 - DNA, 36 bp, Homo sapiens
tttgtaaatttctgccaggtgcgccatttatatgat

SEQ ID NO: 3588 - DNA, 62 bp, Homo sapiens
gatctcggtttactgcaacctccacctcctgagttccagcgattctcctgcctcagcctcct

SEQ ID NO: 3589 - DNA, 36 bp, Homo sapiens
aggggctcgctggctgaggtggctggcctgcaggtg

SEQ ID NO: 3590 - DNA, 36 bp, Homo sapiens
gcgacgagatggggtctggagatgagctgccctgtg

SEQ ID NO: 3591 - DNA, 25 bp, Homo sapiens
tatccatccattcacccactcagcc

SEQ ID NO: 3592 - DNA, 36 bp, Homo sapiens
ctggccaagcgcctgctggtggctggcctgcaggtg

SEQ ID NO: 3593 - DNA, 500 bp, Homo sapiens
ggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaaca

SEQ ID NO: 3594 - DNA, 500 bp, Homo sapiens
catcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctgg

SEQ ID NO: 3595 - DNA, 36 bp, Homo sapiens
tgaaggaagccatcattgtgggccaggtgaactatc

SEQ ID NO: 3596 - DNA, 36 bp, Homo sapiens
tctgcatcccccacccaggttgtgtctcaacttccg

SEQ ID NO: 3597 - DNA, 132 bp, Homo sapiens
gaaaaatgtctcaaattgggtataacaaatcagcgtgattgcctttcacctccactttggagtgctttgagccagtttggacacaaggaggttggagttaaaatgactcctgaaggaagtaagcaagcatga

SEQ ID NO: 3598 - DNA, 500 bp, Homo sapiens
ccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcag

SEQ ID NO: 3599 - DNA, 57 bp, Homo sapiens
ttgcccacgctggtctcgaattcctggcctcaaatgatccatccacctcagcctccc

SEQ ID NO: 3600 - DNA, 313 bp, Homo sapiens
cggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagct

SEQ ID NO: 3601 - DNA, 500 bp, Homo sapiens
agagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtg

SEQ ID NO: 3602 - DNA, 67 bp, Homo sapiens
tccgttcccctgcagcaccatctcctttggctcttcggcaaccagtgaaagcatttagtaaccatgg

SEQ ID NO: 3603 - DNA, 301 bp, Homo sapiens
tccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcag

SEQ ID NO: 3604 - DNA, 500 bp, Homo sapiens
cgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaac

SEQ ID NO: 3605 - DNA, 36 bp, Homo sapiens
tcaacagcgccattttagagtcccagaacctgccaa

SEQ ID NO: 3606 - DNA, 36 bp, Homo sapiens
gcaggcagtgctgcagaacatggtttcatcttacct

SEQ ID NO: 3607 - DNA, 500 bp, Homo sapiens
ctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaac

SEQ ID NO: 3608 - DNA, 500 bp, Homo sapiens
atggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgt

SEQ ID NO: 3609 - DNA, 500 bp, Homo sapiens
tcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgt

SEQ ID NO: 3610 - DNA, 36 bp, Homo sapiens
tagtgtcacaatttcccgggaccatggctaaacctc

SEQ ID NO: 3611 - DNA, 36 bp, Homo sapiens
aggaacgacacttcccaggatagcagtgcacgaacc

SEQ ID NO: 3612 - DNA, 456 bp, Homo sapiens
gtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacac

SEQ ID NO: 3613 - DNA, 500 bp, Homo sapiens
aagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttc

SEQ ID NO: 3614 - DNA, 228 bp, Homo sapiens
atccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaac

SEQ ID NO: 3615 - DNA, 500 bp, Homo sapiens
gcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttactt

SEQ ID NO: 3616 - DNA, 500 bp, Homo sapiens
taagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagcta

SEQ ID NO: 3617 - DNA, 221 bp, Homo sapiens
gacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccg

SEQ ID NO: 3618 - DNA, 500 bp, Homo sapiens
aaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaaga

SEQ ID NO: 3619 - DNA, 79 bp, Homo sapiens
aaatataaagatgctactaataaacacagccatctgcacagagaagataaacatataacgattgaggatttatggaaac

SEQ ID NO: 3620 - DNA, 500 bp, Homo sapiens
aagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgaga

SEQ ID NO: 3621 - DNA, 500 bp, Homo sapiens
atcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtct

SEQ ID NO: 3622 - DNA, 203 bp, Homo sapiens
gacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaa

SEQ ID NO: 3623 - DNA, 36 bp, Homo sapiens
tgtgagctccctgcctcgggcctccctgggaggaat

SEQ ID NO: 3624 - DNA, 79 bp, Homo sapiens
tggggttttgatgtgttgcccaggctggtcttgaactcctgagcttaagtgatgtgtccgcctgggcctcccaaagtgc

SEQ ID NO: 3625 - DNA, 36 bp, Homo sapiens
ccggcattcacacctcgggctccctcagctcccgct

SEQ ID NO: 3626 - DNA, 36 bp, Homo sapiens
gaagaggcccacgtctcgggctccctccccgtcagg

SEQ ID NO: 3627 - DNA, 36 bp, Homo sapiens
cctcttccttccacgcagcctgcccctgaggttttg

SEQ ID NO: 3628 - DNA, 36 bp, Homo sapiens
ctggacgtgacctcctcagtgcagactggaatttgg

SEQ ID NO: 3629 - DNA, 158 bp, Homo sapiens
agaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcac

SEQ ID NO: 3630 - DNA, 36 bp, Homo sapiens
ccccagcagctggagatgaaccccccgaccctaacc

SEQ ID NO: 3631 - DNA, 36 bp, Homo sapiens
tccatgcagttctttgtggagaatcccagtgaagaa

SEQ ID NO: 3632 - DNA, 500 bp, Homo sapiens
ggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcacaatcatcccctcatgtagactccag

SEQ ID NO: 3633 - DNA, 191 bp, Homo sapiens
atggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttc

SEQ ID NO: 3634 - DNA, 472 bp, Homo sapiens
gaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaag

SEQ ID NO: 3635 - DNA, 330 bp, Homo sapiens
cgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaag

SEQ ID NO: 3636 - DNA, 336 bp, Homo sapiens
accctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaag

SEQ ID NO: 3637 - DNA, 500 bp, Homo sapiens
taaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcgcagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatg

SEQ ID NO: 3638 - DNA, 500 bp, Homo sapiens
tgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcag

SEQ ID NO: 3639 - DNA, 141 bp, Homo sapiens
gcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagt

SEQ ID NO: 3640 - DNA, 500 bp, Homo sapiens
tgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctg

SEQ ID NO: 3641 - DNA, 160 bp, Homo sapiens
tgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaat

SEQ ID NO: 3642 - DNA, 500 bp, Homo sapiens
gagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaa

SEQ ID NO: 3643 - DNA, 173 bp, Homo sapiens
aactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttc

SEQ ID NO: 3644 - DNA, 144 bp, Homo sapiens
tagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagg

SEQ ID NO: 3645 - DNA, 122 bp, Homo sapiens
tactgctccatcaggagacctcacccgcccacaccacattgcatcagttgttcccaaccgctaccctcgctggttcactctaagccacattgagtcccagcagtgtgagctggcatccacca

SEQ ID NO: 3646 - DNA, 114 bp, Homo sapiens
gagcccacgccttcaccgttcttgccttccccaagcctgaagctccccctttcacacagtgcactccccagtcaggccctgggtgggattgcctccgggctgggcatgcaaaac

SEQ ID NO: 3647 - DNA, 36 bp, Homo sapiens
tagtagcatggagtcacgaaacagggaccgagaaaa

SEQ ID NO: 3648 - DNA, 500 bp, Homo sapiens
gaagaagatgaagaaggacaaaaagtaactattcatgacaaaacagaaattaacctggtctcatttcgtcgtacaatttatcttgctattcagtcaagtttagattttgaagaatgtgctcacaaattgctgaaaatggagtttcctgaaagccaaacaaaagaactctgcaacatgatacttgattgctgtgcccaacagaggacatacgaaaaattttttggcttattagctgggcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgttcttgaatgtataaaactgagtgaagaaaccactacatcatccagtagaatttttgtcaaaatatttttccaggaactgtgtgaatacatgggtcttcctaaacttaa

SEQ ID NO: 3649 - DNA, 36 bp, Homo sapiens
agctggactctcccactggccaaagcacccctacgc

SEQ ID NO: 3650 - DNA, 36 bp, Homo sapiens
gcaccgactctctgcctggcccgatttcccgccaac

SEQ ID NO: 3651 - DNA, 36 bp, Homo sapiens
tgaagagctgggaccgagcgccgacattcctaaggg

SEQ ID NO: 3652 - DNA, 36 bp, Homo sapiens
ccagacacagatccagaggtgcagtggcctgggggg

SEQ ID NO: 3653 - DNA, 36 bp, Homo sapiens
gatgctccgcgcgttcagcccctcggggcgtctccg

SEQ ID NO: 3654 - DNA, 36 bp, Homo sapiens
tccttgatgggatcccaggtgctcatccgaggagct

SEQ ID NO: 3655 - DNA, 36 bp, Homo sapiens
gtggtgacggaggccgaggtgactgggctgccgccc

SEQ ID NO: 3656 - DNA, 79 bp, Homo sapiens
cacagcccctcctccacgaaggcccagagcaggagccggaggccattgccagagcccaggaatggactgtgcccattcg

SEQ ID NO: 3657 - DNA, 36 bp, Homo sapiens
tgccctgtctcccagcagccgtgcccccgagggtgc

SEQ ID NO: 3658 - DNA, 519 bp, Homo sapiens
gacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctg

SEQ ID NO: 3659 - DNA, 36 bp, Homo sapiens
cacctctgcagggacactggtggctcctccagttcc

SEQ ID NO: 3660 - DNA, 500 bp, Homo sapiens
ccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtg

SEQ ID NO: 3661 - DNA, 500 bp, Homo sapiens
ccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactggg

SEQ ID NO: 3662 - DNA, 179 bp, Homo sapiens
ccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcat

SEQ ID NO: 3663 - DNA, 500 bp, Homo sapiens
aaagccccctcattcgagactgccctccggctgcctgcctctggcacccacttggcccctggccacagccactccctggaacatgactctccgagcaccccccgcccctcctcggaggcctgcggtgaggcacagcgactgccttcagcccctccgggggggcccctatcagggacatggggcaccctcagggctccaagcagcttccatccactggtggccacccaggcactgctcagccagagaggccatccccggacagcccttgggggcagccagcccctttctgccaccccaagcagggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcat

SEQ ID NO: 3664 - DNA, 36 bp, Homo sapiens
tgaagagctgggaccgagacggagcccccctggaga

SEQ ID NO: 3665 - DNA, 500 bp, Homo sapiens
catgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcac

SEQ ID NO: 3666 - DNA, 87 bp, Homo sapiens
catgcccggatatcggggaggtgtacgcggatggggtgctgctggtctggaagcccgtggaatcctacggccctgtgacctacattg

SEQ ID NO: 3667 - DNA, 500 bp, Homo sapiens
tggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtg

SEQ ID NO: 3668 - DNA, 500 bp, Homo sapiens
cgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcatt

SEQ ID NO: 3669 - DNA, 500 bp, Homo sapiens
gggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccagcccctcggggcgtctccgtcctcacacccatgcgcgtttattccacccgccgtgcgccttcctctcttccatcacgctgacctgcagccccgcagcccgctttctccgccgtcgggccagccgcttgtttccacaacttctctgccccgggaagagttcttgggcaaagcgtgcaagcgagggcgagaagccgcgggccacgatccgctggaggagaggaggcttcagagtcgctggcgcgtggcctcggtgaaaagcaacccagtgtttgagattccatgggcaatgactacgctggccgagccccgccctgccccttgccaggagtgca

SEQ ID NO: 3670 - DNA, 36 bp, Homo sapiens
ccgcccctgtcgccctagcccaggcccacgcgcggc

SEQ ID NO: 3671 - DNA, 108 bp, Homo sapiens
tactgtaagcattgcctgctgccatgtttccttactgtgtttttccgtgattgctgggataccacctgcttatctgacctctacaatgctaaagacctgcttgcctgg

SEQ ID NO: 3672 - DNA, 36 bp, Homo sapiens
cttctcgctctccgtcaggaccgcgacggcaccatc

SEQ ID NO: 3673 - DNA, 36 bp, Homo sapiens
gtcccagctactcgggaggctgaggcaggagaattg

SEQ ID NO: 3674 - DNA, 36 bp, Homo sapiens
ggcggcggcgaggctgaggcggccggcgcggggcgc

SEQ ID NO: 3675 - DNA, 36 bp, Homo sapiens
ctgaaaatgagaaatgtgatcatccagcgggaggta

SEQ ID NO: 3676 - DNA, 87 bp, Homo sapiens
aggtgccatttgtgccatagattatacgtggaatttactaaaagctgggaaaataccagaggaatttaatgtatttaatttaataca

SEQ ID NO: 3677 - DNA, 36 bp, Homo sapiens
tctactcattcactgcagggatggatctcagcaaac

SEQ ID NO: 3678 - DNA, 36 bp, Homo sapiens
gcagcaatgctatctcagatgtcccaggagagagga

SEQ ID NO: 3679 - DNA, 36 bp, Homo sapiens
tggcccttctgattgcagatgtcccaggagagagga

SEQ ID NO: 3680 - DNA, 36 bp, Homo sapiens
tttcaaccacaacaatagctactactccatctaagc

SEQ ID NO: 3681 - DNA, 125 bp, Homo sapiens
aaggacgcatgctgtttcttagggacacggctgacttccagatatgaccatgtatttgtggcttaaactcttggcatttggctttgcctttctggacacagaagtatttgtgacagggcaaagcc

SEQ ID NO: 3682 - DNA, 162 bp, Homo sapiens
tgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgcta

SEQ ID NO: 3683 - DNA, 108 bp, Homo sapiens
gtacagccagcacctttcctacagacccagtttccccattgacaaccaccctcagccttgcacaccacagctctgctgccttacctgcacgcacctccaacaccacca

SEQ ID NO: 3684 - DNA, 500 bp, Homo sapiens
attctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactc

SEQ ID NO: 3685 - DNA, 80 bp, Homo sapiens
ttgatgatttctggaggatgatttgggaacagaaagccacagttattgtcatggtcactcgatgtgaagaaggaaacagg

SEQ ID NO: 3686 - DNA, 500 bp, Homo sapiens
ataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgt

SEQ ID NO: 3687 - DNA, 500 bp, Homo sapiens
gataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatct

SEQ ID NO: 3688 - DNA, 500 bp, Homo sapiens
agcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgct

SEQ ID NO: 3689 - DNA, 500 bp, Homo sapiens
aactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacagga

SEQ ID NO: 3690 - DNA, 500 bp, Homo sapiens
aggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctact

SEQ ID NO: 3691 - DNA, 500 bp, Homo sapiens
cacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaat

SEQ ID NO: 3692 - DNA, 500 bp, Homo sapiens
tggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacagga

SEQ ID NO: 3693 - DNA, 500 bp, Homo sapiens
gtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatat

SEQ ID NO: 3694 - DNA, 500 bp, Homo sapiens
tggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatca

SEQ ID NO: 3695 - DNA, 143 bp, Homo sapiens
gtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacc

SEQ ID NO: 3696 - DNA, 500 bp, Homo sapiens
gggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagc

SEQ ID NO: 3697 - DNA, 500 bp, Homo sapiens
gagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacc

SEQ ID NO: 3698 - DNA, 37 bp, Homo sapiens
acacaagtgacagtgctgatggcccttctgattgcag

SEQ ID NO: 3699 - DNA, 30 bp, Homo sapiens
gcaatgctatctcagacacaagtgacagtg

SEQ ID NO: 3700 - DNA, 36 bp, Homo sapiens
ttctcaccaccggggaagctggtcacccttctgcag

SEQ ID NO: 3701 - DNA, 36 bp, Homo sapiens
acctctgggctcctaccgggcttgtgtggctggctt

SEQ ID NO: 3702 - DNA, 222 bp, Homo sapiens
atctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgg

SEQ ID NO: 3703 - DNA, 36 bp, Homo sapiens
tcttgtttgtgtttgcagagctataaacagccttca

SEQ ID NO: 3704 - DNA, 500 bp, Homo sapiens
ataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccag

SEQ ID NO: 3705 - DNA, 36 bp, Homo sapiens
aaggagctgggattacaggtgcctgccaccacaccc

SEQ ID NO: 3706 - DNA, 250 bp, Homo sapiens
catgactccacctggaccttatggctccacccagaagcaattcagcccaacaggaggacagcttcaacccattacgatttcatctctgccccaaccactcagcagcaagcacctgttacctgtccacccccaccccttcccccaaactgcctttgaaaaatccctaacctatgagctttgaataagatgagtacgaacttcatcgcccacgtggcgtggccggcctcgtgtctattaaattctttttcta

SEQ ID NO: 3707 - DNA, 36 bp, Homo sapiens
atgagccctgcagccccggtcccgcctgactccgct

SEQ ID NO: 3708 - DNA, 325 bp, Homo sapiens
gcccaggctgatcttgaactcctggcctcaggtgatcctcctgcctcaacttcccaaagcactaggattacaaatagacagggtcttgctctgccgcacaggccagagtgcagtggcccatcatagctcattccactgagcccaagtgatcctcctgcctcagcctcctgagtcactgggactacagtgacagggtcttgctctgttgaccaggctggagtgttaaaggcacgatcatggctcacggcagcctctacttcatgggctcaagcgatcctcctgcctcagcctcccaagtagctagcctacaggcacatgccaccaa

SEQ ID NO: 3709 - DNA, 57 bp, Homo sapiens
ttgcccaggctggtctcgaactcctggactcaagtgatccaccagcctcagcttccc

SEQ ID NO: 3710 - DNA, 36 bp, Homo sapiens
aaatggatgatagtcgagaaggagaacttatggatt

SEQ ID NO: 3711 - DNA, 36 bp, Homo sapiens
agtgtgccagaactgcaaacaatcgggagaagatag

SEQ ID NO: 3712 - DNA, 500 bp, Homo sapiens
taaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacg

SEQ ID NO: 3713 - DNA, 500 bp, Homo sapiens
cagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagt

SEQ ID NO: 3714 - DNA, 500 bp, Homo sapiens
ttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccgcctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagc

SEQ ID NO: 3715 - DNA, 500 bp, Homo sapiens
agtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcgggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaa

SEQ ID NO: 3716 - DNA, 500 bp, Homo sapiens
aagttgaaggccctgaagatcaaatggtattctcagagcaggcagctaataaagatgtcaacggtcaggagtccactcctggaattgttccagatcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaac

SEQ ID NO: 3717 - DNA, 500 bp, Homo sapiens
ggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccaccca

SEQ ID NO: 3718 - DNA, 174 bp, Homo sapiens
atgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacg

SEQ ID NO: 3719 - DNA, 500 bp, Homo sapiens
aagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgt

SEQ ID NO: 3720 - DNA, 500 bp, Homo sapiens
caccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattc

SEQ ID NO: 3721 - DNA, 36 bp, Homo sapiens
ggcagttttggagccatggatgatcctttcaaaaat

SEQ ID NO: 3722 - DNA, 503 bp, Homo sapiens
ttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaat

SEQ ID NO: 3723 - DNA, 500 bp, Homo sapiens
ccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgac

SEQ ID NO: 3724 - DNA, 188 bp, Homo sapiens
gccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctct

SEQ ID NO: 3725 - DNA, 500 bp, Homo sapiens
ggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaacca

SEQ ID NO: 3726 - DNA, 500 bp, Homo sapiens
acaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggag

SEQ ID NO: 3727 - DNA, 37 bp, Homo sapiens
acaagacattcgagaaaaggaagaggcaatcagacag

SEQ ID NO: 3728 - DNA, 500 bp, Homo sapiens
caaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcaga

SEQ ID NO: 3729 - DNA, 500 bp, Homo sapiens
acagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacg

SEQ ID NO: 3730 - DNA, 36 bp, Homo sapiens
gaagctgcttatcaagagcgccttaagaattgggaa

SEQ ID NO: 3731 - DNA, 500 bp, Homo sapiens
agctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagat

SEQ ID NO: 3732 - DNA, 36 bp, Homo sapiens
agaagacctcccactcctccaccgaggcctgctgcg

SEQ ID NO: 3733 - DNA, 82 bp, Homo sapiens
gttggccaggatggtcttgatctcttgacttcatgatccaccctcctcagcctcccaaagtgctgggattacaggtgtgagc

SEQ ID NO: 3734 - DNA, 36 bp, Homo sapiens
tgtggtggtgggagacggagctgtaggtaaaacttg

SEQ ID NO: 3735 - DNA, 36 bp, Homo sapiens
agatggcttttcggccaggtgtggttgacctgcctg

SEQ ID NO: 3736 - DNA, 66 bp, Homo sapiens
gatgaagatgcatcagggggcgatcaagatcaggaagaaagaagatggaacaaaaggactcagcag

SEQ ID NO: 3737 - DNA, 312 bp, Homo sapiens
agccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaa

SEQ ID NO: 3738 - DNA, 94 bp, Homo sapiens
acatcaggacatctcttactgggagtagttcgaatctatcacaggaaagccaaataccttcttgcagactgtaatgaagcattcattaagataa

SEQ ID NO: 3739 - DNA, 71 bp, Homo sapiens
gcagttcagcttgaatcagagtagagtggaagagataaccatgagagaagaagttgggaacatcagtattt

SEQ ID NO: 3740 - DNA, 500 bp, Homo sapiens
gcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattt

SEQ ID NO: 3741 - DNA, 48 bp, Homo sapiens
ggcgatcaagatcaggaagaaagaagatggaacaaaaggactcagcag

SEQ ID NO: 3742 - DNA, 500 bp, Homo sapiens
ggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatct

SEQ ID NO: 3743 - DNA, 61 bp, Homo sapiens
ggacaaaaagacagctacgtgggtgacgaagcacagagcaaaagaggaatcctgaccctga

SEQ ID NO: 3744 - DNA, 36 bp, Homo sapiens
aatgttactcccacaaaggtaacaaaggaataattt

SEQ ID NO: 3745 - DNA, 36 bp, Homo sapiens
ttaaaacaccagaaaaggcaaaagagaagaaaaaac

SEQ ID NO: 3746 - DNA, 36 bp, Homo sapiens
aaagttcaggaagctcaaaaatctcagacagaagaa

SEQ ID NO: 3747 - DNA, 36 bp, Homo sapiens
accgactgagccaatcagggcacatgttgctaaact

SEQ ID NO: 3748 - DNA, 187 bp, Homo sapiens
tcttgttgcccaggctggagtgcaatggcatgctcgtggctcaatgcagccttcatctcccaggttcaagtgaatctccttcctcagcctcccgagtagttgggattacaggtgcctgccaccacgcctggctaatttttgtatttttagtagagacgggatttcgccatgttgggccaggctggtc

SEQ ID NO: 3749 - DNA, 500 bp, Homo sapiens
ttattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagca

SEQ ID NO: 3750 - DNA, 143 bp, Homo sapiens
ttattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaa

SEQ ID NO: 3751 - DNA, 85 bp, Homo sapiens
aggctggagtgcagtggtgtgaacacagatcactgcagcttcaacctcccagggtcaagaaatcctcccaccataacctcctgag

SEQ ID NO: 3752 - DNA, 36 bp, Homo sapiens
ttctgtactgctgactgggtctgttctatagcaagt

SEQ ID NO: 3753 - DNA, 56 bp, Homo sapiens
atctcactgcagcctccgcctcctgggttcaagtgattctcctgcctcagcctcct

SEQ ID NO: 3754 - DNA, 500 bp, Homo sapiens
attcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcat

SEQ ID NO: 3755 - DNA, 500 bp, Homo sapiens
cagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtc

SEQ ID NO: 3756 - DNA, 500 bp, Homo sapiens
tctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctg

SEQ ID NO: 3757 - DNA, 500 bp, Homo sapiens
acgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgc

SEQ ID NO: 3758 - DNA, 231 bp, Homo sapiens
caatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaag

SEQ ID NO: 3759 - DNA, 500 bp, Homo sapiens
ttgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaaaattatctgataggttactattgctaaattaattggccattataataagctgatttgtttcttattcagcaagatctcttttgagaatgtgacaaattaaacatacatagaatccatatggtattatcctgataaagggaaacgaggacactaagact

SEQ ID NO: 3760 - DNA, 36 bp, Homo sapiens
gctacttgggaggctgcggcaggagaatggtgtgaa

SEQ ID NO: 3761 - DNA, 217 bp, Homo sapiens
tgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtccca

SEQ ID NO: 3762 - DNA, 313 bp, Homo sapiens
gatcatagttcatcataactttgaatctctgggcttaagcaatcctcccatgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcaatgaaacaagctctaaaagcattccattccta

SEQ ID NO: 3763 - DNA, 500 bp, Homo sapiens
aatttttaaaagacagggtctcactctcttacccaggctagagtgcagtggtgtgatcatagttcatcataactttgaatctctgggcttaagcaatcctcccatgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcaatgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaa

SEQ ID NO: 3764 - DNA, 36 bp, Homo sapiens
ccgcaggcccggagccaggtgtatagaagtgttttg

SEQ ID NO: 3765 - DNA, 500 bp, Homo sapiens
aattgccagcaaacattttcgttttgcggagatgctttactataaagtattagaatctgttattgagcaggaacaaaaaagactaggagacatggatttatctggtattctggaacaagatgcattccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgata

SEQ ID NO: 3766 - DNA, 36 bp, Homo sapiens
acagcggttcctgttgaggaggcaagtggtcaacag

SEQ ID NO: 3767 - DNA, 36 bp, Homo sapiens
caagctcaaatggcaaaggtgagttgagagccagca

SEQ ID NO: 3768 - DNA, 387 bp, Homo sapiens
ttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatt

SEQ ID NO: 3769 - DNA, 500 bp, Homo sapiens
caccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttat

SEQ ID NO: 3770 - DNA, 500 bp, Homo sapiens
tgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcg

SEQ ID NO: 3771 - DNA, 36 bp, Homo sapiens
atcccatctttgacaatcgtgcccccaacactgccg

SEQ ID NO: 3772 - DNA, 513 bp, Homo sapiens
gtggggactacgacctgaatgctgtgcggctctgcttccaggtgacagtgcgggacccatcaggcaggcccctccgcctgccgcctgtccttcctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcg

SEQ ID NO: 3773 - DNA, 36 bp, Homo sapiens
caggagaacggcggctgggatacttttgtggaactc

SEQ ID NO: 3774 - DNA, 500 bp, Homo sapiens
aaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtccc

SEQ ID NO: 3775 - DNA, 36 bp, Homo sapiens
ccatgcccacctgcccatcacagggttgggcccaga

SEQ ID NO: 3776 - DNA, 274 bp, Homo sapiens
ggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatc

SEQ ID NO: 3777 - DNA, 328 bp, Homo sapiens
tatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttgg

SEQ ID NO: 3778 - DNA, 120 bp, Homo sapiens
tatgggaacaatgcagcagccgagagccgaaagggccaggaacgcttcaaccgctggttcctgacgggcatgactgtggccggcgtggttctgctgggctcactcttcagtcggaaatga

SEQ ID NO: 3779 - DNA, 113 bp, Homo sapiens
ggactacagcgatggatcccaggagttctctgctgagttaacattgcactctgaggttctgtctcctgaaatgcttcagtgtacaccagccaatatggtagaagttcacaaag

SEQ ID NO: 3780 - DNA, 500 bp, Homo sapiens
tggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaat

SEQ ID NO: 3781 - DNA, 500 bp, Homo sapiens
agaaaaagaggcaatgctttttaagggtcctaatgtatgtaagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcaga

SEQ ID NO: 3782 - DNA, 62 bp, Homo sapiens
tgaaggcttttggtctccctgggagtgggtggaggcagccagggcttacctgtacactgact

SEQ ID NO: 3783 - DNA, 40 bp, Homo sapiens
cagcctcagccttgcccttctgcagcaacagctgacaccc

SEQ ID NO: 3784 - DNA, 500 bp, Homo sapiens
aaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataag

SEQ ID NO: 3785 - DNA, 500 bp, Homo sapiens
ctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagac

SEQ ID NO: 3786 - DNA, 500 bp, Homo sapiens
ctcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatg

SEQ ID NO: 3787 - DNA, 36 bp, Homo sapiens
caggacaggggccaggaggtaaaacttccttttcct

SEQ ID NO: 3788 - DNA, 113 bp, Homo sapiens
gtcacaaggttgccccacaaaactttggggtccatgtctgaatggattgccagagccttctcatctctcccttcgcccagttccctgcatcctaagactcgaaggcagcacag

SEQ ID NO: 3789 - DNA, 36 bp, Homo sapiens
gggcgctacaggcctcaggccctcaggtactgtcag

SEQ ID NO: 3790 - DNA, 500 bp, Homo sapiens
atctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcg

SEQ ID NO: 3791 - DNA, 49 bp, Homo sapiens
gttgtccacaaaataggcgaataggcacctcttatctctgttcaccttc

SEQ ID NO: 3792 - DNA, 151 bp, Homo sapiens
caacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcag

SEQ ID NO: 3793 - DNA, 500 bp, Homo sapiens
acagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgt

SEQ ID NO: 3794 - DNA, 36 bp, Homo sapiens
aataaaacaacacaccagcttttatttgttaggcat

SEQ ID NO: 3795 - DNA, 36 bp, Homo sapiens
aattcaggcaagcacaatgatcatatccagagtccc

SEQ ID NO: 3796 - DNA, 53 bp, Homo sapiens
aggaggagatcagtaatcttaaggctgcctttgaaaagaatatcaacactgaa

SEQ ID NO: 3797 - DNA, 36 bp, Homo sapiens
cttacagacaaagcagaggtgagtgaaggcaaggca

SEQ ID NO: 3798 - DNA, 168 bp, Homo sapiens
gatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctca

SEQ ID NO: 3799 - DNA, 60 bp, Homo sapiens
ctcctgacctcaggtgattcacctgcctcggcctcccaaagtgctgggattacaggcgtg

SEQ ID NO: 3800 - DNA, 36 bp, Homo sapiens
cggggtgtggccatgaatcctgtggagcatcctttt

SEQ ID NO: 3801 - DNA, 324 bp, Homo sapiens
aacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgc

SEQ ID NO: 3802 - DNA, 36 bp, Homo sapiens
gggaactatgccaccgttatctcccacaaccctgag

SEQ ID NO: 3803 - DNA, 36 bp, Homo sapiens
tcagggaactatgccaccgttatctcccacaaccct

SEQ ID NO: 3804 - DNA, 36 bp, Homo sapiens
gttgcccagaagaaaaagatatcccagaagaaactg

SEQ ID NO: 3805 - DNA, 405 bp, Homo sapiens
tttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgacc

SEQ ID NO: 3806 - DNA, 68 bp, Homo sapiens
aacaaggaccgaaaggttcggcgcaaggagcccaagagccaggatatctacctgaggctgttggtcaa

SEQ ID NO: 3807 - DNA, 51 bp, Homo sapiens
aacaaggaccgaaaggttcggcgcaaggagcccaagagccaggatatctac

SEQ ID NO: 3808 - DNA, 500 bp, Homo sapiens
agaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 3809 - DNA, 92 bp, Homo sapiens
ggagtggacatccgccataacaaggaccgaaaggttcggcgcaaggagcccaagagccaggatatctacctgaggctgttggtcaagttata

SEQ ID NO: 3810 - DNA, 88 bp, Homo sapiens
accagccgggcccgcagccgcatcctcagggcagggggcaagatcctcactttcgaccagctggccctggactcccctaagggctgtg

SEQ ID NO: 3811 - DNA, 69 bp, Homo sapiens
ggagtggacatccgccataacaaggaccgaaaggttcggcgcaaggagcccaagagccaggatatctac

SEQ ID NO: 3812 - DNA, 72 bp, Homo sapiens
agaagaaccaactccacattcaaccaggttgtgttgaagaggttgtttatgagtcgcaccaaccggccgcct

SEQ ID NO: 3813 - DNA, 202 bp, Homo sapiens
ccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgt

SEQ ID NO: 3814 - DNA, 36 bp, Homo sapiens
agcagggacgcgccccaggtgggcagctgtggcaga

SEQ ID NO: 3815 - DNA, 106 bp, Homo sapiens
gatctcggctcaccgcaccctctgccttccaggttcaagtgattctcctgcctcagcctcccaagtagctgggattataggcatgtgccaccatgcctggctaatt

SEQ ID NO: 3816 - DNA, 36 bp, Homo sapiens
ggagataagaagagaaagggccaagtgatccagttc

SEQ ID NO: 3817 - DNA, 36 bp, Homo sapiens
gacgaccggctcaacaaggttatcagtgagctgaat

SEQ ID NO: 3818 - DNA, 99 bp, Homo sapiens
agaagaaggaggagtctgaagagtcagatgatgacatgggatttggcctttttgattaaattcctgctcccctgcaaataaagcctttttacacatctc

SEQ ID NO: 3819 - DNA, 68 bp, Homo sapiens
aagaagcggaccttccgcaagttcacctaccgcggcgtggacctcgaccagctgctggacatgtccta

SEQ ID NO: 3820 - DNA, 68 bp, Homo sapiens
gcagaagtagagcagaagaagaagcggaccttccgcaagttcacctaccgcggcgtggacctcgacca

SEQ ID NO: 3821 - DNA, 36 bp, Homo sapiens
aagacgcacctgcgggacatgatcatcctacccgag

SEQ ID NO: 3822 - DNA, 187 bp, Homo sapiens
gttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtg

SEQ ID NO: 3823 - DNA, 199 bp, Homo sapiens
gtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttc

SEQ ID NO: 3824 - DNA, 36 bp, Homo sapiens
attgagccaggagttgaggtggaagtcaccattgca

SEQ ID NO: 3825 - DNA, 36 bp, Homo sapiens
gttggtgctggcaaaaagtgagctggagattggatc

SEQ ID NO: 3826 - DNA, 36 bp, Homo sapiens
gttggtgctggcaaaaagccgaaggagtaaaggtgc

SEQ ID NO: 3827 - DNA, 500 bp, Homo sapiens
gaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtga

SEQ ID NO: 3828 - DNA, 84 bp, Homo sapiens
ccgaaggagtaaaggtgctgcaatgatgttagctgtggccactgtggatttttcgcaagaacattaataaactaaaaacttcat

SEQ ID NO: 3829 - DNA, 36 bp, Homo sapiens
gtgaagatgcatgaataggtccaaccagctgtacat

SEQ ID NO: 3830 - DNA, 36 bp, Homo sapiens
caagcgtcctgcccggccgttgctccgactgtgtgt

SEQ ID NO: 3831 - DNA, 36 bp, Homo sapiens
tttctcttggtctttaagttggacacacttaaagaa

SEQ ID NO: 3832 - DNA, 36 bp, Homo sapiens
agctcagcagctcctcaggtaatacagacactcagg

SEQ ID NO: 3833 - DNA, 354 bp, Homo sapiens
gatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaatta

SEQ ID NO: 3834 - DNA, 156 bp, Homo sapiens
agaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagtt

SEQ ID NO: 3835 - DNA, 500 bp, Homo sapiens
caaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagagg

SEQ ID NO: 3836 - DNA, 498 bp, Homo sapiens
gatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgag

SEQ ID NO: 3837 - DNA, 500 bp, Homo sapiens
aacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaa

SEQ ID NO: 3838 - DNA, 500 bp, Homo sapiens
agcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatag

SEQ ID NO: 3839 - DNA, 500 bp, Homo sapiens
gaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactg

SEQ ID NO: 3840 - DNA, 500 bp, Homo sapiens
gtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtaga

SEQ ID NO: 3841 - DNA, 36 bp, Homo sapiens
cggcactctgcctcccagggtccctgcaccgggaac

SEQ ID NO: 3842 - DNA, 36 bp, Homo sapiens
tgtctttcagaagacctggtggggcaagtccgtggg

SEQ ID NO: 3843 - DNA, 36 bp, Homo sapiens
tgtcctcagtatatcaggaaaaagggtgcagacgtc

SEQ ID NO: 3844 - DNA, 194 bp, Homo sapiens
tggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 3845 - DNA, 357 bp, Homo sapiens
catcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctca

SEQ ID NO: 3846 - DNA, 25 bp, Homo sapiens
atgtctcttgtcagctgtctttcag

SEQ ID NO: 3847 - DNA, 25 bp, Homo sapiens
gtctcttgtcagctgtctttcagaa

SEQ ID NO: 3848 - DNA, 194 bp, Homo sapiens; identical to SEQ ID NO: 3844

SEQ ID NO: 3849 - DNA, 344 bp, Homo sapiens
aaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccatggccacagtcatggtggccacggccacagccactaatcaggaggccaggccaccctgcctctacccaaccagggccccggggcctgttatgtcaaactgtcttggctgtggggctaggggctggggccaaa

SEQ ID NO: 3850 - DNA, 36 bp, Homo sapiens
tttaagaatgattttaggttacagccaagttctact

SEQ ID NO: 3851 - DNA, 36 bp, Homo sapiens
ccacattatcagtctcagcatcctcatgtctatagt

SEQ ID NO: 3852 - DNA, 36 bp, Homo sapiens
gaggcccggcctgggcaggtgggtgtcggcacccca

SEQ ID NO: 3853 - DNA, 36 bp, Homo sapiens
gcacccagtcctgttcagcaccatcagcaccaggcc

SEQ ID NO: 3854 - DNA, 500 bp, Homo sapiens
agcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcag

SEQ ID NO: 3855 - DNA, 514 bp, Homo sapiens
ccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagc

SEQ ID NO: 3856 - DNA, 167 bp, Homo sapiens
agcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcag

SEQ ID NO: 3857 - DNA, 351 bp, Homo sapiens
catctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggt

SEQ ID NO: 3858 - DNA, 36 bp, Homo sapiens
catcagtggtcagtggggctgcatctcctacgcctg

SEQ ID NO: 3859 - DNA, 174 bp, Homo sapiens
cttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgccta

SEQ ID NO: 3860 - DNA, 271 bp, Homo sapiens
ctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaaga

SEQ ID NO: 3861 - DNA, 500 bp, Homo sapiens
gccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagc

SEQ ID NO: 3862 - DNA, 500 bp, Homo sapiens
tcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctc

SEQ ID NO: 3863 - DNA, 500 bp, Homo sapiens
atgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctac

SEQ ID NO: 3864 - DNA, 500 bp, Homo sapiens
ccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaaga

SEQ ID NO: 3865 - DNA, 36 bp, Homo sapiens
ctccaacccagcagtcgtctttgtcacccgaaagaa

SEQ ID NO: 3866 - DNA, 445 bp, Homo sapiens
ccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagct

SEQ ID NO: 3867 - DNA, 25 bp, Homo sapiens
gcggcgagcggttccttgtgggcta

SEQ ID NO: 3868 - DNA, 36 bp, Homo sapiens
cactttacctctgggcaggttcatcaatgcccggag

SEQ ID NO: 3869 - DNA, 36 bp, Homo sapiens
cccgggatcacccgaacagtcctccatgtgaatcaa

SEQ ID NO: 3870 - DNA, 36 bp, Homo sapiens
ctggtgcggctctggaggagccctgcccttccaccc

SEQ ID NO: 3871 - DNA, 93 bp, Homo sapiens
aggctggagtgtggcgcgatctcagctcacagcaagctccgcctcccgagtttacaccattcttctgcctcagcctcccaagtagctgggact

SEQ ID NO: 3872 - DNA, 26 bp, Homo sapiens
cctgcctcggcctcctgagtggctgg

SEQ ID NO: 3873 - DNA, 36 bp, Homo sapiens
cctccccaccctcttcagggtcattcccgtagagta

SEQ ID NO: 3874 - DNA, 36 bp, Homo sapiens
gggctggacagttaccaggtaagacaagcagactta

SEQ ID NO: 3875 - DNA, 36 bp, Homo sapiens
tatgacctgcagtctgggaattccggggagaaagtc

SEQ ID NO: 3876 - DNA, 500 bp, Homo sapiens
acatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagag

SEQ ID NO: 3877 - DNA, 248 bp, Homo sapiens
gaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcac

SEQ ID NO: 3878 - DNA, 500 bp, Homo sapiens
ggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaaga

SEQ ID NO: 3879 - DNA, 500 bp, Homo sapiens
agccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaat

SEQ ID NO: 3880 - DNA, 500 bp, Homo sapiens
cctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtc

SEQ ID NO: 3881 - DNA, 95 bp, Homo sapiens
gcagatacctctcaagatatccagctttttggcataggaattcagcctcagcactgtgagattgacattgcatctgatggagacgtcactctcac

SEQ ID NO: 3882 - DNA, 500 bp, Homo sapiens
cgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatgggg

SEQ ID NO: 3883 - DNA, 500 bp, Homo sapiens
gaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagctcaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacac

SEQ ID NO: 3884 - DNA, 36 bp, Homo sapiens
gtttgtgatcattttcaggttggtcttggacaactg

SEQ ID NO: 3885 - DNA, 36 bp, Homo sapiens
agaaagtacggaaaccagctttgaccgccattgaag

SEQ ID NO: 3886 - DNA, 500 bp, Homo sapiens
tcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggc

SEQ ID NO: 3887 - DNA, 500 bp, Homo sapiens
cacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgt

SEQ ID NO: 3888 - DNA, 500 bp, Homo sapiens
gaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctattt

SEQ ID NO: 3889 - DNA, 36 bp, Homo sapiens
agcagctccgagtctccacagcgcgacccgcccccg

SEQ ID NO: 3890 - DNA, 36 bp, Homo sapiens
gtctcccacctgttacaggaccaccacctccacttc

SEQ ID NO: 3891 - DNA, 36 bp, Homo sapiens
agttcaaaacccacacatgtgagtattcttggtaat

SEQ ID NO: 3892 - DNA, 36 bp, Homo sapiens
ggtgcactcttcagagagggtgactgttggatctgt

SEQ ID NO: 3893 - DNA, 67 bp, Homo sapiens
agttgaattttgcaaatccacctttcaaatctacagcaaggtttactctgaatcccaatcctacagg

SEQ ID NO: 3894 - DNA, 500 bp, Homo sapiens
cagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctct

SEQ ID NO: 3895 - DNA, 36 bp, Homo sapiens
cagcctttatctgccttgggctcctggtgcagcaga

SEQ ID NO: 3896 - DNA, 36 bp, Homo sapiens
acccttttgacttctatatggacctgacgtcagtgg

SEQ ID NO: 3897 - DNA, 36 bp, Homo sapiens
acccttttgacttctatagtaagtttttctttcaca

SEQ ID NO: 3898 - DNA, 36 bp, Homo sapiens
acccttttgacttctatagagagtgacaagaaactt

SEQ ID NO: 3899 - DNA, 36 bp, Homo sapiens
gtttttttgcttgtttaggtccctttctagagatag

SEQ ID NO: 3900 - DNA, 214 bp, Homo sapiens
tctcaccaccctctgaatctgcattagccagtcaactagccctttcagcgtcatgtgaccagcgcgccccattcagcttggctggtgtcgtttcacatgacccaggctggccagtcgtcaggttgcatctcagccttctctccaaccttaaccaaatcggcagcagccacctcgaccgcccacacattcctggccaatcagctcagctgtttat

SEQ ID NO: 3901 - DNA, 36 bp, Homo sapiens
caggatcaccgactgcctcattagtcacaggaggga

SEQ ID NO: 3902 - DNA, 145 bp, Homo sapiens
cccaagcttctcccgagtgcagctcagtgaagaagcctccttgcattacattcactcatcggaaacgctgaccctgaccctgaaccacacagccgagcatttgttggaggcagatattaaactcttccggaaatacttttgggat

SEQ ID NO: 3903 - DNA, 132 bp, Homo sapiens
ggggtgattgaatttgtatcttattctgatatgaaaagagctttggaaaagttggatggaactgaagtcaatgggagaaaaatcagattagttgaagacaagccaggttccagacgacgccggtcctactcc

SEQ ID NO: 3904 - DNA, 500 bp, Homo sapiens
tcttgtttataatactttataaatatgtttaatgatgtgtgtttgtgttgttgttgtttttttctctgtaatgcaattgtttaacatagatttaacaaagacctcaatgttttaattaaaagaatcctttgaggctaagatgactgcctgttccatttgctgaccttgggttacctttccatgcgtggctctttgaaccattgtggcccttggctgaccaaaaacaggaagccatgtgacgaccgcaacctttccccattagacctgggtggtgaggatcccaagggttagacacagatgagattaaactgaaataggtgcctgaaaatctttttttttccatataaaatattcacaaaatgtttaatcactgtgagtaacaccagtaactgatttagtaatttggttacttatttctaaattgttaaattgttaatagttttaaatttatgcatgttaatcttaaatgcaaatattaatgaatatgtatacttacaact

SEQ ID NO: 3905 - DNA, 125 bp, Homo sapiens
atatggttttgtggagtttgatgatctgcgtgatgcagatgatgctgtttatgaactgaatggcaaagacctttgtggtgagcgagtaattgttgagcatgcccgcggcccacggcgagatggca

SEQ ID NO: 3906 - DNA, 159 bp, Homo sapiens
tgactgcctgttccatttgctgaccttgggttacctttccatgcgtggctctttgaaccattgtggcccttggctgaccaaaaacaggaagccatgtgacgaccgcaacctttccccattagacctgggtggtgaggatcccaagggttagacacagat

SEQ ID NO: 3907 - DNA, 459 bp, Homo sapiens
cacacatgttttcggaaggaccagatggctgacactggctaatgggaaccaaaagacgagtgaaagtaacctggttgtcacatacccccagcttagaggtgcttcaccctgccccaaggtggggaaagatcaagtgcagactgagctgtggccaacgtttgcagaccaggaatccacactagctctaatcagagagcccttggtgtgcgggaactgccagtttgccgacgtgaaaagagtcccagactgggtaatggtgagccctgaagtcgcaccccagctctgccactcagtgagcacggcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtgg

SEQ ID NO: 3908 - DNA, 136 bp, Homo sapiens
agacaagctggggaagtaacgtttgcggatgcacaccgacctaaattaaatgaaggggtggttgagtttgcctcttatggtgacttaaagaatgctattgaaaaactttctggaaaggaaataaatgggagaaaaa

SEQ ID NO: 3909 - DNA, 47 bp, Homo sapiens
gtaacgcttccgaataagaggtccggtcgaaaagagttgaaagatac

SEQ ID NO: 3910 - DNA, 238 bp, Homo sapiens
agttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaa

SEQ ID NO: 3911 - DNA, 500 bp, Homo sapiens
gatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccaattgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcag

SEQ ID NO: 3912 - DNA, 86 bp, Homo sapiens
acccaggctggagtgcagtggcacgatctaggctcactgcaacctccgcctcccaggttcaagtgattctcctgtctcaccctcct

SEQ ID NO: 3913 - DNA, 36 bp, Homo sapiens
cttgaagagctgatgaagcccttgaaggtagtggac

SEQ ID NO: 3914 - DNA, 36 bp, Homo sapiens
ctgctgtggataaaagaggtctagatgtggatggca

SEQ ID NO: 3915 - DNA, 36 bp, Homo sapiens
ctctccaaacccaaacagaaagcctcacattgtgca

SEQ ID NO: 3916 - DNA, 36 bp, Homo sapiens
tctgatgggccccacaaggtacttggaggaaaacta

SEQ ID NO: 3917 - DNA, 99 bp, Homo sapiens
acagtactgagtgggatgacattcatgtggtcaccggagccctgaagctttttctccgggagctgccccagcctctggtgccaccactgctgctgcccc

SEQ ID NO: 3918 - DNA, 500 bp, Homo sapiens
gagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgt

SEQ ID NO: 3919 - DNA, 500 bp, Homo sapiens
cctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcct

SEQ ID NO: 3920 - DNA, 500 bp, Homo sapiens
gtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagc

SEQ ID NO: 3921 - DNA, 25 bp, Homo sapiens
ggaccaactcctgctcctgaatctt

SEQ ID NO: 3922 - DNA, 500 bp, Homo sapiens
atgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagctttctgaagcctttccaggaaggaccaagcggaagatccctctccca

SEQ ID NO: 3923 - DNA, 500 bp, Homo sapiens
ccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaatta

SEQ ID NO: 3924 - DNA, 36 bp, Homo sapiens
tttttttttctgcctaagtctcatgatcgattacaa

SEQ ID NO: 3925 - DNA, 500 bp, Homo sapiens
attccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctg

SEQ ID NO: 3926 - DNA, 500 bp, Homo sapiens
agcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcata

SEQ ID NO: 3927 - DNA, 500 bp, Homo sapiens
ggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaagg

SEQ ID NO: 3928 - DNA, 500 bp, Homo sapiens
tctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggaga

SEQ ID NO: 3929 - DNA, 36 bp, Homo sapiens
tatctccctctgccttagctcccccgcgcctttggt

SEQ ID NO: 3930 - DNA, 36 bp, Homo sapiens
atcctgttcaagggcaagcacatttgcaggtcggcc

SEQ ID NO: 3931 - DNA, 166 bp, Homo sapiens
tatagacggggtttcaccatgttggccaggctggtctttacctcctgacctcaggtgatctgccgcctgagcctccccaagtgtgggattacaggcatgagccactgtgcctggccagaaactgaattggagcttgatgtaggggaaccggtaaaggaaccactgg

SEQ ID NO: 3932 - DNA, 36 bp, Homo sapiens
gtaattaccccagaagagtttgtggcagctggagat

SEQ ID NO: 3933 - DNA, 36 bp, Homo sapiens
cactggaagtgtttgatggtaagtttctttaatctt

SEQ ID NO: 3934 - DNA, 36 bp, Homo sapiens
tcgtggcctgcacctcggctttcctgctctgggacc

SEQ ID NO: 3935 - DNA, 36 bp, Homo sapiens
gccccacctggttcaaaggaagcagaagtgcaagca

SEQ ID NO: 3936 - DNA, 150 bp, Homo sapiens
gcagcatctctccgcggggatactcttccagctccacgcctcaacagtctaattacagtacctccagcaacagtatgaatggctacagcaatgtccccatggccaacttgggtgttccaggttcaccaggatttctaaatggctcaccca

SEQ ID NO: 3937 - DNA, 137 bp, Homo sapiens
cagcgccgggccttggaagcctttgacctggatcctgcacagtggggagtcaatgtccagccctactccgggtccccagccaacctggccgtctacacagcccttctgcaacctcacgaccggatcatggggctgga

SEQ ID NO: 3938 - DNA, 176 bp, Homo sapiens
gtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgccc

SEQ ID NO: 3939 - DNA, 36 bp, Homo sapiens
cagcccttctgcaacctcacgaccggatcatggggc

SEQ ID NO: 3940 - DNA, 36 bp, Homo sapiens
cctggacatgaccaactggaacctacaagcagcaat

SEQ ID NO: 3941 - DNA, 81 bp, Homo sapiens
aggctggagtgcagtggtgtgatatggctcactgcagccttgacctcccaggctccagagatcctcccacctcagccacct

SEQ ID NO: 3942 - DNA, 102 bp, Homo sapiens
gtggctcacgcctgtaatcccagcactttgggaggctgaggcgggcggatcacgaggtcaagagatccagaccatcctggccaacatggtgaaaccccatct

SEQ ID NO: 3943 - DNA, 57 bp, Homo sapiens
ccactcaggctggtctggaactactgggctcaagcaattccccagcctcagcctcct

SEQ ID NO: 3944 - DNA, 128 bp, Homo sapiens
ccatccgtgggggtctgcaatggccacctttagccgccaggaatttttccagcagctactgcaaggctgtctcctgcctactgcccagcagggccttgaccagatctggctgctccttgccatctgcc

SEQ ID NO: 3945 - DNA, 36 bp, Homo sapiens
ttattgtcctggagataggacgcgtgaccaaaacca

SEQ ID NO: 3946 - DNA, 36 bp, Homo sapiens
tattcggttgaccagagggtatgcatccatgtggaa

SEQ ID NO: 3947 - DNA, 36 bp, Homo sapiens
acttcaaaaaattggggatctaggtgcggtgcaggc

SEQ ID NO: 3948 - DNA, 193 bp, Homo sapiens
aagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattgggga

SEQ ID NO: 3949 - DNA, 121 bp, Homo sapiens
aagacggccatgaagtgagatcgtgcaaagtagcagataaaacgggcagcatcactatttccgtgtgggatgagatcggaggtcttatacagccaggggatattattcggttgaccagagg

SEQ ID NO: 3950 - DNA, 36 bp, Homo sapiens
tggcggcagcaccagcaggaatgaaaggaattaccc

SEQ ID NO: 3951 - DNA, 172 bp, Homo sapiens
tctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaa

SEQ ID NO: 3952 - DNA, 500 bp, Homo sapiens
agccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcacc

SEQ ID NO: 3953 - DNA, 500 bp, Homo sapiens
ttggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccga

SEQ ID NO: 3954 - DNA, 36 bp, Homo sapiens
catccagtgagtcagaagattcagcgtttgttggaa

SEQ ID NO: 3955 - DNA, 500 bp, Homo sapiens
gaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattat

SEQ ID NO: 3956 - DNA, 80 bp, Homo sapiens
gctggagttcagtggcgcgatctcggctcactgcaacctctgcctcccaggtttaagcgattctcctgcctcagcctcct

SEQ ID NO: 3957 - DNA, 58 bp, Homo sapiens
tgttcaagaagatgtccaactcagagatcatccagcacctaacagagcgtttaatgag

SEQ ID NO: 3958 - DNA, 36 bp, Homo sapiens
cctttacctgcaccccaggcctttcagaaaactcga

SEQ ID NO: 3959 - DNA, 207 bp, Homo sapiens
cgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 3960 - DNA, 36 bp, Homo sapiens
ggggcttcagcacctcggccgtcctgggccgccgga

SEQ ID NO: 3961 - DNA, 36 bp, Homo sapiens
gctgaatatgcaggacagttggcagaactgaggcag

SEQ ID NO: 3962 - DNA, 36 bp, Homo sapiens
taaggtgcatgggtagagccttgatacatcatcaaa

SEQ ID NO: 3963 - DNA, 515 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcactt

SEQ ID NO: 3964 - DNA, 104 bp, Homo sapiens
ctatgcccttctgctccaacacctcccggttttggtctggttaccccggtatcctgtgcgtgactggctcctgggtgacctgttatccggcctgagtgtggcca

SEQ ID NO: 3965 - DNA, 36 bp, Homo sapiens
gattccctgaaggaactgacgcatctcaaggaatac

SEQ ID NO: 3966 - DNA, 36 bp, Homo sapiens
gtgaaataacagatacagttgctgcctctacagctc

SEQ ID NO: 3967 - DNA, 36 bp, Homo sapiens
ggaccttctctaacccagtcccagcaacctctagag

SEQ ID NO: 3968 - DNA, 36 bp, Homo sapiens
gtgacttctgcggttggtcctgtgtccatggcggct

SEQ ID NO: 3969 - DNA, 233 bp, Homo sapiens
ccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaa

SEQ ID NO: 3970 - DNA, 423 bp, Homo sapiens
gtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctct

SEQ ID NO: 3971 - DNA, 81 bp, Homo sapiens
cgagtagtagaatgtcaattagagactcataataggaaaatggttacattcaaatttgacctagatggtgacaaccccgag

SEQ ID NO: 3972 - DNA, 435 bp, Homo sapiens
agaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagct

SEQ ID NO: 3973 - DNA, 108 bp, Homo sapiens
ctgttggggcaacagtgaacagccaagccgcccaagctcagcctcctgccatgacgtccagcaggaagggcacattcacagatgacttgcacaagttggtagacaatt

SEQ ID NO: 3974 - DNA, 500 bp, Homo sapiens
ggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatccc

SEQ ID NO: 3975 - DNA, 500 bp, Homo sapiens
agccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctct

SEQ ID NO: 3976 - DNA, 500 bp, Homo sapiens
aaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaac

SEQ ID NO: 3977 - DNA, 48 bp, Homo sapiens
gaacttccagcaggtactctacccagcgagcagctgccaccttttcca

SEQ ID NO: 3978 - DNA, 36 bp, Homo sapiens
atcggatccctcctggtcagcctcccgagtagctgg

SEQ ID NO: 3979 - DNA, 87 bp, Homo sapiens
attggccaggctggtcttaaactcctgaccttgtgatccgcctgccttggcctcccaaagtgctgggattacaggcgtgagccattg

SEQ ID NO: 3980 - DNA, 500 bp, Homo sapiens
gtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctgga

SEQ ID NO: 3981 - DNA, 101 bp, Homo sapiens
cggccgcggccggggcctccatgatccaccccaacgtgccggccatcatgatcacgcccatctgcccccactcgctgtccttccggcccatcgtggtcccc

SEQ ID NO: 3982 - DNA, 94 bp, Homo sapiens
cctgtacttcactgtggtcctgaactgaagagctgtgtttttcaggaagacttggccaggccgtgttccgtgtctctggattcaagtcccagga

SEQ ID NO: 3983 - DNA, 498 bp, Homo sapiens
atggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaag

SEQ ID NO: 3984 - DNA, 500 bp, Homo sapiens
attgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcc

SEQ ID NO: 3985 - DNA, 36 bp, Homo sapiens
cctaaccgatgccgccggctgctggctaccaatatt

SEQ ID NO: 3986 - DNA, 36 bp, Homo sapiens
agtctcttcctttccccgctgctggctaccaatatt

SEQ ID NO: 3987 - DNA, 36 bp, Homo sapiens
cgccggctctgcccccagggcgtcctcgcgggacta

SEQ ID NO: 3988 - DNA, 36 bp, Homo sapiens
ctgcccgctgttccccaggcaggcatctattggctg

SEQ ID NO: 3989 - DNA, 36 bp, Homo sapiens
aagatcctggaggccaaggtgtggggtgatgctgcc

SEQ ID NO: 3990 - DNA, 36 bp, Homo sapiens
aacccactcctcccccagcctccctgtttgtggtca

SEQ ID NO: 3991 - DNA, 154 bp, Homo sapiens
gccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaag

SEQ ID NO: 3992 - DNA, 326 bp, Homo sapiens
gccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccct

SEQ ID NO: 3993 - DNA, 36 bp, Homo sapiens
gcccaagctacggaccttccgcctgcactccaacca

SEQ ID NO: 3994 - DNA, 36 bp, Homo sapiens; identical to SEQ ID NO: 3993

SEQ ID NO: 3995 - DNA, 322 bp, Homo sapiens
attgcaagctccgcctcccaagttcatgccattctcctgcctcagcctcccaagtagctgggactacaggcgcctgccaccatgcccggctaatttttttgtatttttggtagagacggggtttcaccgtgttagccaggatggtctgtatctcctgacctcgtgatccgcccgcctcggcctcccaaagtgctgggattacaggtgtgagccactgcgcccggccacacaagtcttctatcactataaataagttttgcctattctagaacttcatatacattgaattctacagtatgtactattttaagtctggcgtttt

SEQ ID NO: 3996 - DNA, 63 bp, Homo sapiens
gtcagccgaaaatgagagcacacctattcagcaactcctggaacacttcctccgccagcttca

SEQ ID NO: 3997 - DNA, 36 bp, Homo sapiens
atgagccagagaagcttgaaggagctgaagaggaaa

SEQ ID NO: 3998 - DNA, 36 bp, Homo sapiens
gacagagagaaagaagctctagaacaacagaggcag

SEQ ID NO: 3999 - DNA, 36 bp, Homo sapiens
ctcatccaccccagccaggtcagataccaggcccag

SEQ ID NO: 4000 - DNA, 36 bp, Homo sapiens
tgttcatttgctttccagggaacatttacggatgag

SEQ ID NO: 4001 - DNA, 500 bp, Homo sapiens
gaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccacc

SEQ ID NO: 4002 - DNA, 416 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccg

SEQ ID NO: 4003 - DNA, 500 bp, Homo sapiens
ggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacatt

SEQ ID NO: 4004 - DNA, 500 bp, Homo sapiens
agaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcac

SEQ ID NO: 4005 - DNA, 226 bp, Homo sapiens
cagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccac

SEQ ID NO: 4006 - DNA, 500 bp, Homo sapiens
ccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcc

SEQ ID NO: 4007 - DNA, 36 bp, Homo sapiens
gcgggcgacgccgggcggccctctggaccccgaggt

SEQ ID NO: 4008 - DNA, 36 bp, Homo sapiens
ttgtcaagccccttgaaggatcacaaactctgtatc

SEQ ID NO: 4009 - DNA, 500 bp, Homo sapiens
cgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataat

SEQ ID NO: 4010 - DNA, 39 bp, Homo sapiens
gaactaaaacttcacctgcaagcttccaaagatgcccaa

SEQ ID NO: 4011 - DNA, 36 bp, Homo sapiens
cctcattcttcccagcaggccaggcctcatggggcg

SEQ ID NO: 4012 - DNA, 500 bp, Homo sapiens
ccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtatttgctgtctgtttcatgcctgaaagtagtcagcctaactatagatacct

SEQ ID NO: 4013 - DNA, 35 bp, Homo sapiens
cttagatggcttagacacaccgtcagagaatagta

SEQ ID NO: 4014 - DNA, 80 bp, Homo sapiens
ggcggagtgcagtggtgccatcacagcttactgcagtctccacctctcaggctcaagtgattctcctacctcagcctccc

SEQ ID NO: 4015 - DNA, 500 bp, Homo sapiens
gtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctact

SEQ ID NO: 4016 - DNA, 267 bp, Homo sapiens
gaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacag

SEQ ID NO: 4017 - DNA, 36 bp, Homo sapiens
agctccatggactcccagatgttagcaactagcact

SEQ ID NO: 4018 - DNA, 253 bp, Homo sapiens
gctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaac

SEQ ID NO: 4019 - DNA, 349 bp, Homo sapiens
gagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgag

SEQ ID NO: 4020 - DNA, 108 bp, Homo sapiens
ggagcctggaggactagcgaggaggagttgagagaacggagcggacgccatggcgaccaacatcgagcagatttttaggtctttcgtggtcagtaaattccgggaaat

SEQ ID NO: 4021 - DNA, 75 bp, Homo sapiens
gcaatgagtgaacgggcacttgctcagaaaagactcagtgagaatgcatttgatcttgaagccatgagcatgtta

SEQ ID NO: 4022 - DNA, 36 bp, Homo sapiens
tcccctgtcccctggcagaagagaacgagttcattc

SEQ ID NO: 4023 - DNA, 36 bp, Homo sapiens
ctgatgaagccaactgcgaaaaccccacagaagccc

SEQ ID NO: 4024 - DNA, 36 bp, Homo sapiens
gggacgaggccaattgccccacacacagcaccttga

SEQ ID NO: 4025 - DNA, 36 bp, Homo sapiens
atataatgtctactacagggtggttggagagagcat

SEQ ID NO: 4026 - DNA, 36 bp, Homo sapiens
cttcttggttctcggcaggtgaatggctatgtggtg

SEQ ID NO: 4027 - DNA, 36 bp, Homo sapiens
accggcccccggaatgtggtgagtcagccagaatga

SEQ ID NO: 4028 - DNA, 500 bp, Homo sapiens
gaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgagg

SEQ ID NO: 4029 - DNA, 145 bp, Homo sapiens
caaaccaaataccatctacattgaacgacacgaaccctctggctactccactgtcttccgaagtacagatttcttccagtcccgggaaaaccaggaagtgatccttgaggaagtgagagattttcagcttcgggacaagtacatg

SEQ ID NO: 4030 - DNA, 500 bp, Homo sapiens
agcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtc

SEQ ID NO: 4031 - DNA, 500 bp, Homo sapiens
tggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggag

SEQ ID NO: 4032 - DNA, 500 bp, Homo sapiens
ctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtca

SEQ ID NO: 4033 - DNA, 56 bp, Homo sapiens
gacttccgactcacaatcgtcaattcctctgtgcttgatcgtcccagggctctggt

SEQ ID NO: 4034 - DNA, 500 bp, Homo sapiens
gactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgact

SEQ ID NO: 4035 - DNA, 500 bp, Homo sapiens
tgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggct

SEQ ID NO: 4036 - DNA, 96 bp, Homo sapiens
cttgcatgagcagggagttccagtgcgaggacggggaggcctgcattgtgctctcggagcgctgcgacggcttcctggactgctcggacgagagcg

SEQ ID NO: 4037 - DNA, 497 bp, Homo sapiens
atgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaac

SEQ ID NO: 4038 - DNA, 500 bp, Homo sapiens
ctctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgacc

SEQ ID NO: 4039 - DNA, 28 bp, Homo sapiens
gtgagtcagccagaatgaccatcacaaa

SEQ ID NO: 4040 - DNA, 30 bp, Homo sapiens
aatgaccatcacaaagtttatggtattttc

SEQ ID NO: 4041 - DNA, 36 bp, Homo sapiens
cgagcccttttcactcaagtaggtgcaaaaattcta

SEQ ID NO: 4042 - DNA, 514 bp, Homo sapiens
catttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccg

SEQ ID NO: 4043 - DNA, 500 bp, Homo sapiens
ggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaat

SEQ ID NO: 4044 - DNA, 474 bp, Homo sapiens
gacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 4045 - DNA, 500 bp, Homo sapiens
ttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaa

SEQ ID NO: 4046 - DNA, 174 bp, Homo sapiens
catcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattca

SEQ ID NO: 4047 - DNA, 500 bp, Homo sapiens
gcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaag

SEQ ID NO: 4048 - DNA, 68 bp, Homo sapiens
gcactgggtagagcaccacttctatgattttgaaagagatgcatatcttttgcaacgaatggaagaat

SEQ ID NO: 4049 - DNA, 36 bp, Homo sapiens
ctagaccatacctttgaggcactgcaggaaaggaaa

SEQ ID NO: 4050 - DNA, 429 bp, Homo sapiens
gttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 4051 - DNA, 36 bp, Homo sapiens
tagtctcaaactcctgacctcagcctcccaaagtgc

SEQ ID NO: 4052 - DNA, 94 bp, Homo sapiens
agaacctactgacgcagacaaattggcaatagagaaaggcgagcagccaatcagtgcagaccttaaaagatttcgcaaggaatatgtccaacca

SEQ ID NO: 4053 - DNA, 500 bp, Homo sapiens
ttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggt

SEQ ID NO: 4054 - DNA, 36 bp, Homo sapiens
ttctctggcccctcccaggtctacatccgcacgcct

SEQ ID NO: 4055 - DNA, 36 bp, Homo sapiens
aggagcgattcaaacaaggaacctcaaagaagtgta

SEQ ID NO: 4056 - DNA, 36 bp, Homo sapiens
gttccccatctcatgctggtacaaccccacctgaaa

SEQ ID NO: 4057 - DNA, 36 bp, Homo sapiens
aatcaaaccatggtttaggtacaaccccacctgaaa

SEQ ID NO: 4058 - DNA, 36 bp, Homo sapiens
tgccctgtgatgaagaaagcccagaggcagagctac

SEQ ID NO: 4059 - DNA, 49 bp, Homo sapiens
ttcctcccacaccccttaatcacacttgctgctggttcctgctgccgct

SEQ ID NO: 4060 - DNA, 500 bp, Homo sapiens
ccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattc

SEQ ID NO: 4061 - DNA, 36 bp, Homo sapiens
gcttcggcatcaagcagaaggatatcgacaaggatc

SEQ ID NO: 4062 - DNA, 500 bp, Homo sapiens
cctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgt

SEQ ID NO: 4063 - DNA, 36 bp, Homo sapiens
ttactttttccttgtcagaaagtggagctgttccaa

SEQ ID NO: 4064 - DNA, 215 bp, Homo sapiens
aatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggc

SEQ ID NO: 4065 - DNA, 437 bp, Homo sapiens
accaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatccgcccaccttggccctcccaattgctgggattacaggcctgagacaccatgcccagcctcctattctttatctgaaaaattaacaagatttccagttaaagtaagaattgacatctttaagagaaattctgaattatagtttattttcatacagctgtttatgtttataatctcatttttttttaattactgagaaaatagagtagctaagatctaatcttggagtgcattgttac

SEQ ID NO: 4066 - DNA, 36 bp, Homo sapiens
ctgctgaaaaagcaacagatgctggagaatcagatg

SEQ ID NO: 4067 - DNA, 36 bp, Homo sapiens
gatgtggaggacgagatcttgtgggttggagagagg

SEQ ID NO: 4068 - DNA, 36 bp, Homo sapiens
tcagaggagaaggccaaggatgagcagagtgctgtc

SEQ ID NO: 4069 - DNA, 36 bp, Homo sapiens
tcagaggagaaggccaaggtgagaggaggcgggaag

SEQ ID NO: 4070 - DNA, 36 bp, Homo sapiens
gactatgagcatgtcacgatgttacaagaacgattc

SEQ ID NO: 4071 - DNA, 36 bp, Homo sapiens
cactatgcatctgaggagatcaaggaaaaattactg

SEQ ID NO: 4072 - DNA, 36 bp, Homo sapiens
ctctctggagagaggctggtgagtggagaccttagg

SEQ ID NO: 4073 - DNA, 36 bp, Homo sapiens
cgagtcccagcagcagtgggatacttcaaaaggaga

SEQ ID NO: 4074 - DNA, 36 bp, Homo sapiens
ttccaagccaaagacgatgaggaaatgaacacatgg

SEQ ID NO: 4075 - DNA, 36 bp, Homo sapiens
aactgttggaccccgaagacatcagcgtggaccatc

SEQ ID NO: 4076 - DNA, 36 bp, Homo sapiens
atctctgacatcaacaaggcctgggaaagactggaa

SEQ ID NO: 4077 - DNA, 36 bp, Homo sapiens
tggatcgctgagagggaggtggtcgcagggtcccat

SEQ ID NO: 4078 - DNA, 500 bp, Homo sapiens
cgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggct

SEQ ID NO: 4079 - DNA, 141 bp, Homo sapiens
cgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagct

SEQ ID NO: 4080 - DNA, 500 bp, Homo sapiens
acacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgcc

SEQ ID NO: 4081 - DNA, 500 bp, Homo sapiens
acaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggt

SEQ ID NO: 4082 - DNA, 121 bp, Homo sapiens
ggatgtatcatctgttgaactcttaatgaataatcatcaaggcatcaaagctgaaattgatgcacgtaatgacagtttcacaacctgcattgaacttgggaaatccctgttggcgagaaaa

SEQ ID NO: 4083 - DNA, 152 bp, Homo sapiens
tctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagagg

SEQ ID NO: 4084 - DNA, 197 bp, Homo sapiens
acaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggc

SEQ ID NO: 4085 - DNA, 432 bp, Homo sapiens
ggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcga

SEQ ID NO: 4086 - DNA, 116 bp, Homo sapiens
agaagaagaccttcaccaagtgggtcaattcccaccttgcccgtgtgtcctgccggatcacagacctgtacactgaccttcgagatggacggatgctcatcaagctgctggaggtc

SEQ ID NO: 4087 - DNA, 500 bp, Homo sapiens
cgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgactta

SEQ ID NO: 4088 - DNA, 500 bp, Homo sapiens
gaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgc

SEQ ID NO: 4089 - DNA, 500 bp, Homo sapiens
tcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaact

SEQ ID NO: 4090 - DNA, 500 bp, Homo sapiens
tcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcacta

SEQ ID NO: 4091 - DNA, 500 bp, Homo sapiens
cttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacc

SEQ ID NO: 4092 - DNA, 500 bp, Homo sapiens
tgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcac

SEQ ID NO: 4093 - DNA, 500 bp, Homo sapiens
aaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgtt

SEQ ID NO: 4094 - DNA, 123 bp, Homo sapiens
aaagcggaacacgaaagagaactggctttgcggaatgagctcataagacaggagaaactggaacagctcgcccgcagatttgatcgcaaggcagctatgagggagacttggctgagcgaaaac

SEQ ID NO: 4095 - DNA, 500 bp, Homo sapiens
ttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctc

SEQ ID NO: 4096 - DNA, 500 bp, Homo sapiens
cttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgtta

SEQ ID NO: 4097 - DNA, 500 bp, Homo sapiens
tgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagt

SEQ ID NO: 4098 - DNA, 102 bp, Homo sapiens
agaaatgaacaaccaggcttcccgggttgcagtggtgaaccagattgcacgccagctgatgcacagcggccacccaagtgagaaggaaatcaaagcccagca

SEQ ID NO: 4099 - DNA, 500 bp, Homo sapiens
aggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatct

SEQ ID NO: 4100 - DNA, 500 bp, Homo sapiens
tcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaacacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggc

SEQ ID NO: 4101 - DNA, 500 bp, Homo sapiens
gaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagca

SEQ ID NO: 4102 - DNA, 189 bp, Homo sapiens
gaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagg

SEQ ID NO: 4103 - DNA, 54 bp, Homo sapiens
atgcctttggcaacttccacggatcatggccacaacctccagactgtgcagctg

SEQ ID NO: 4104 - DNA, 500 bp, Homo sapiens
acaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaacacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagg

SEQ ID NO: 4105 - DNA, 169 bp, Homo sapiens
gcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacag

SEQ ID NO: 4106 - DNA, 103 bp, Homo sapiens
actcttaatgaataatcatcaaggcatcaaagctgaaattgatgcacgtaatgacagtttcacaacctgcattgaacttgggaaatccctgttggcgagaaaa

SEQ ID NO: 4107 - DNA, 500 bp, Homo sapiens
cgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccc

SEQ ID NO: 4108 - DNA, 77 bp, Homo sapiens
cgcagacagcaagaggaagaggagaggaagaggcggccgccttctcccgagccgagcacgaaggtttcagaggaagc

SEQ ID NO: 4109 - DNA, 500 bp, Homo sapiens
gaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagc

SEQ ID NO: 4110 - DNA, 500 bp, Homo sapiens
ttgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactct

SEQ ID NO: 4111 - DNA, 77 bp, Homo sapiens
aggctggagtgcagtggtgtgatctcggctcactgcaacctccacctcctgggttcaagcgattctcctgcctcagc

SEQ ID NO: 4112 - DNA, 36 bp, Homo sapiens
ttgttggagagcgagcagttcctgacggagctgacc

SEQ ID NO: 4113 - DNA, 36 bp, Homo sapiens
agtacactcgagatgaaggtgagtccccttaaccat

SEQ ID NO: 4114 - DNA, 43 bp, Homo sapiens
gcagagataccctgtgaagatgaacaagagcaagaacataacg

SEQ ID NO: 4115 - DNA, 60 bp, Homo sapiens
ctaaccaggctggtcttgaactcctggcctcaagggatcctctcaccaccttggcctccc

SEQ ID NO: 4116 - DNA, 46 bp, Homo sapiens
agctgaagccctggagcctctttgatgtacttgtggaaaagtatgg

SEQ ID NO: 4117 - DNA, 211 bp, Homo sapiens
aacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcag

SEQ ID NO: 4118 - DNA, 36 bp, Homo sapiens
tggaagccattgcttttgcacgtaaccaaggctttg

SEQ ID NO: 4119 - DNA, 186 bp, Homo sapiens
atgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagag

SEQ ID NO: 4120 - DNA, 466 bp, Homo sapiens
ctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtcca

SEQ ID NO: 4121 - DNA, 500 bp, Homo sapiens
atgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatttgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagac

SEQ ID NO: 4122 - DNA, 155 bp, Homo sapiens
acattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggat

SEQ ID NO: 4123 - DNA, 135 bp, Homo sapiens
cccaatgcccccaagaggcccatgtctgcatacatgctgtggctcaatgccagccgagagaagatcaagtcagaccatcctggcatcagcatcacggatctttccaagaaggcaggcgagatctggaagggaatg

SEQ ID NO: 4124 - DNA, 36 bp, Homo sapiens
gagggagtgggtggagagcatgggtggtaaagtacc

SEQ ID NO: 4125 - DNA, 500 bp, Homo sapiens
tattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggg

SEQ ID NO: 4126 - DNA, 233 bp, Homo sapiens
taatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaacttta

SEQ ID NO: 4127 - DNA, 455 bp, Homo sapiens
aagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatga

SEQ ID NO: 4128 - DNA, 40 bp, Homo sapiens
aagaaggtggaggaagacttaaaggcagacgaaccatcaa

SEQ ID NO: 4129 - DNA, 500 bp, Homo sapiens
gatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagta

SEQ ID NO: 4130 - DNA, 36 bp, Homo sapiens
ttgcctgggtttgtgtaggtctgcaggaaggaaggc

SEQ ID NO: 4131 - DNA, 500 bp, Homo sapiens
acgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatc

SEQ ID NO: 4132 - DNA, 36 bp, Homo sapiens
ttttttctttttaaataggttgctggtcaaattccc

SEQ ID NO: 4133 - DNA, 36 bp, Homo sapiens
tgggctaaattttgcaaagaaaacatggctggcaag

SEQ ID NO: 4134 - DNA, 36 bp, Homo sapiens
tggagaaggacatcagcggtaagacccagatccagt

SEQ ID NO: 4135 - DNA, 36 bp, Homo sapiens
ctgaagctgacccaggtagcgctgccccatacctga

SEQ ID NO: 4136 - DNA, 36 bp, Homo sapiens
gccccccatttcctacagaacgacctgcagcaatac

SEQ ID NO: 4137 - DNA, 36 bp, Homo sapiens
atcaagcagtttcttcagagcaggtatcttgagaag

SEQ ID NO: 4138 - DNA, 36 bp, Homo sapiens
tgtccccccgcactttagattcattgatgcagtttg

SEQ ID NO: 4139 - DNA, 36 bp, Homo sapiens
gtttatctgtgtgacaccattcattgatgcagtttg

SEQ ID NO: 4140 - DNA, 500 bp, Homo sapiens
cacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaa

SEQ ID NO: 4141 - DNA, 25 bp, Homo sapiens
tattcagggtgtcagatcacatggg

SEQ ID NO: 4142 - DNA, 388 bp, Homo sapiens
agaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaacc

SEQ ID NO: 4143 - DNA, 109 bp, Homo sapiens
agaatcacatgccactttggtgtttcataatctcctgggagagattgaccagcagtatagccgcttcctgcaagagtcgaatgttctctatcagcacaatctacgaaga

SEQ ID NO: 4144 - DNA, 350 bp, Homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttg

SEQ ID NO: 4145 - DNA, 500 bp, Homo sapiens
ccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctaga

SEQ ID NO: 4146 - DNA, 500 bp, Homo sapiens
caccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccc

SEQ ID NO: 4147 - DNA, 60 bp, Homo sapiens
caccccacagcagccgtggtgacggagaagcagcagatgctggagcagcaccttcaggat

SEQ ID NO: 4148 - DNA, 500 bp, Homo sapiens
tgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcg

SEQ ID NO: 4149 - DNA, 500 bp, Homo sapiens
cagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctg

SEQ ID NO: 4150 - DNA, 500 bp, Homo sapiens
cagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctca

SEQ ID NO: 4151 - DNA, 177 bp, Homo sapiens
ccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatc

SEQ ID NO: 4152 - DNA, 500 bp, Homo sapiens
agaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgtt

SEQ ID NO: 4153 - DNA, 500 bp, Homo sapiens
ggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatc

SEQ ID NO: 4154 - DNA, 57 bp, Homo sapiens
acactctcactccatccccccgtatcaaggcctctccccagaagaatcagtcaacgt

SEQ ID NO: 4155 - DNA, 36 bp, Homo sapiens
gctcggagcagcagccagagtttattaaccacttaa

SEQ ID NO: 4156 - DNA, 36 bp, Homo sapiens
ttgcctgtgaatttcgaggtggcccgggagagtggc

SEQ ID NO: 4157 - DNA, 36 bp, Homo sapiens
acaaaacccatagtcaagccacagacaagcccagaa

SEQ ID NO: 4158 - DNA, 36 bp, Homo sapiens
agggagtttgtgatgcaggtgaaggttggaaaccac

SEQ ID NO: 4159 - DNA, 500 bp, Homo sapiens
gaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaa

SEQ ID NO: 4160 - DNA, 500 bp, Homo sapiens
actgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggacta

SEQ ID NO: 4161 - DNA, 36 bp, Homo sapiens
agagaaacttggagaagggtcctatggcagcgtata

SEQ ID NO: 4162 - DNA, 36 bp, Homo sapiens
gtagcaggtcaacttacagataccatggccaagcgg

SEQ ID NO: 4163 - DNA, 36 bp, Homo sapiens
taactcagagttttaaaccccaggaacagagactcc

SEQ ID NO: 4164 - DNA, 36 bp, Homo sapiens
atccacccgcctcggcctcccagcttgtcaggaggc

SEQ ID NO: 4165 - DNA, 500 bp, Homo sapiens
tctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctg

SEQ ID NO: 4166 - DNA, 151 bp, Homo sapiens
tctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaag

SEQ ID NO: 4167 - DNA, 500 bp, Homo sapiens
agcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggta

SEQ ID NO: 4168 - DNA, 122 bp, Homo sapiens
agcctgcgaaaccatcctttcttgaatattttgaacaaaaagaaaaggaaaaccagatcaacagctttggcaagagtgtacctggtccactgaaaaattcttcagattggaaaataccacag

SEQ ID NO: 4169 - DNA, 500 bp, Homo sapiens
gaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaa

SEQ ID NO: 4170 - DNA, 36 bp, Homo sapiens
cgtgagaagatcaagcagttctcccagcaggaggag

SEQ ID NO: 4171 - DNA, 36 bp, Homo sapiens
gaggctggccgcctgcagcccgtgtccaggagcccc

SEQ ID NO: 4172 - DNA, 36 bp, Homo sapiens
actgaaaagccccggccggcctccccagggtccccg

SEQ ID NO: 4173 - DNA, 36 bp, Homo sapiens
aggctgaccacggacaaggcgaacatcaaagaccta

SEQ ID NO: 4174 - DNA, 36 bp, Homo sapiens
tggctgagggcatcaccattgttgaagacatcaaca

SEQ ID NO: 4175 - DNA, 36 bp, Homo sapiens
atatcttcttcaccgacacctgccccgagcccctgt

SEQ ID NO: 4176 - DNA, 47 bp, Homo sapiens
tttgggcggaactggctttgttgaccgggagaaacgagatgggggtg

SEQ ID NO: 4177 - DNA, 120 bp, Homo sapiens
aacggcgggaacccattcccagtctggaggccatttatttgctgagccccacggagaagtcggttcaggccctgatcaaagacttccaggggaccccgactttcacctacaaagcggccc

SEQ ID NO: 4178 - DNA, 320 bp, Homo sapiens
tcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgag

SEQ ID NO: 4179 - DNA, 43 bp, Homo sapiens
aaagacttccaggggaccccgactttcacctacaaagcggccc

SEQ ID NO: 4180 - DNA, 500 bp, Homo sapiens
acacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaag

SEQ ID NO: 4181 - DNA, 46 bp, Homo sapiens
ccaagcatgcgcatcttgtcttcctgctgcaaaatgtcagatatcc

SEQ ID NO: 4182 - DNA, 59 bp, Homo sapiens
ttgcccaggctggtctcaaactcctgagctcaagcaatccacctgcctcaacctcccaa

SEQ ID NO: 4183 - DNA, 36 bp, Homo sapiens
caacatccagctccacggaggccctcatgaacggct

SEQ ID NO: 4184 - DNA, 56 bp, Homo sapiens
gaattgaggagagagtaggatgctgattttcctacccgtggcccaggtctgtgcct

SEQ ID NO: 4185 - DNA, 36 bp, Homo sapiens
gggtgggagggatttgggttggtggattaacagatg

SEQ ID NO: 4186 - DNA, 500 bp, Homo sapiens
agaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatc

SEQ ID NO: 4187 - DNA, 36 bp, Homo sapiens
ctgcaggagcgcgcggagattctggctacattggag

SEQ ID NO: 4188 - DNA, 500 bp, Homo sapiens
gctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcag

SEQ ID NO: 4189 - DNA, 500 bp, Homo sapiens
agcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaa

SEQ ID NO: 4190 - DNA, 36 bp, Homo sapiens
gatgaaaactactacaaggcccagacccatggaaag

SEQ ID NO: 4191 - DNA, 125 bp, Homo sapiens
gccatcatcagtcagaagcctcagctggagaagctgatcgctaccacagcccatgaaaaaatgccttggttccatggaaaaatctctcgggaagaatctgagcaaattgtcctgataggatcaaa

SEQ ID NO: 4192 - DNA, 36 bp, Homo sapiens
gggccctacacgcctcagcctcctgatttgtatgat

SEQ ID NO: 4193 - DNA, 219 bp, Homo sapiens
gcccaggctagagtgcagtggtgtgatctcggctcactgcaacctccacctcccgggttcaagcgattttcctgcttcagcctcctgagtaactgggattacaggcacgcatcaccacaccgggctgatttttgtaggctggagtgcagtggtacgatctcagctcactgcaacatccgcctcccgggttcaagcgattcttgtgcctcagcctcctca

SEQ ID NO: 4194 - DNA, 36 bp, Homo sapiens
gccccatccacccagcaggtcctgtccctcagcacc

SEQ ID NO: 4195 - DNA, 36 bp, Homo sapiens
ttgtccatgtatccacagttgctggaagtgcaggtg

SEQ ID NO: 4196 - DNA, 36 bp, Homo sapiens
aactcctggaccactagtgtgagcacctgaagatga

SEQ ID NO: 4197 - DNA, 36 bp, Homo sapiens
attcttacctccctctaggtactgctctccatctac

SEQ ID NO: 4198 - DNA, 500 bp, Homo sapiens
gggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccag

SEQ ID NO: 4199 - DNA, 25 bp, Homo sapiens
aaagtgctggcattacaggcgtgag

SEQ ID NO: 4200 - DNA, 36 bp, Homo sapiens
cctgacctcaggtgatccacccgcttcagcttccca

SEQ ID NO: 4201 - DNA, 36 bp, Homo sapiens
ctctcaggaagcccccaggccgccttccaggagaat

SEQ ID NO: 4202 - DNA, 36 bp, Homo sapiens
agcaggcaacacagggaacctcaggccaggcaccac

SEQ ID NO: 4203 - DNA, 500 bp, Homo sapiens
caagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaag

SEQ ID NO: 4204 - DNA, 212 bp, Homo sapiens
ctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgca

SEQ ID NO: 4205 - DNA, 36 bp, Homo sapiens
tttctttgtttcttttagatgttttcacctcctgtg

SEQ ID NO: 4206 - DNA, 500 bp, Homo sapiens
agcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctc

SEQ ID NO: 4207 - DNA, 183 bp, Homo sapiens
agctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctg

SEQ ID NO: 4208 - DNA, 36 bp, Homo sapiens
gctccttcttcatgcaagatggccatcacagcagtg

SEQ ID NO: 4209 - DNA, 500 bp, Homo sapiens
aagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaagccggactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactt

SEQ ID NO: 4210 - DNA, 36 bp, Homo sapiens
ctccttctcatttttcagcacaaggccaatcagccc

SEQ ID NO: 4211 - DNA, 36 bp, Homo sapiens
cagatcctgggccgcagggtgagaccatgggcaggt

SEQ ID NO: 4212 - DNA, 36 bp, Homo sapiens
accaagaatccaccacaggaggaaaaagaaatgcat

SEQ ID NO: 4213 - DNA, 36 bp, Homo sapiens
cagccgcagcccccgctggagagaaaatgcagcccc

SEQ ID NO: 4214 - DNA, 500 bp, Homo sapiens
tcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaag

SEQ ID NO: 4215 - DNA, 36 bp, Homo sapiens
aaaagggctgccgggccaggcgcggtggctcacgcc

SEQ ID NO: 4216 - DNA, 25 bp, Homo sapiens
aggcggtcgagggaaaagcaccaag

SEQ ID NO: 4217 - DNA, 36 bp, Homo sapiens
tcgcccaccgcccgaacctatctccagatgaaatgg

SEQ ID NO: 4218 - DNA, 25 bp, Homo sapiens
aagaggaaaagggacaagcagccgg

SEQ ID NO: 4219 - DNA, 91 bp, Homo sapiens
agcccaggctggagttcaatggcaccatcttggctcactgcaacctccacagttcaagcgagttcaagtgattctcctgtctcagcttccc

SEQ ID NO: 4220 - DNA, 36 bp, Homo sapiens
atatctggcaggtttgactatccagaggaaattaaa

SEQ ID NO: 4221 - DNA, 500 bp, Homo sapiens
agagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaag

SEQ ID NO: 4222 - DNA, 36 bp, Homo sapiens
ccccacccccatgcccaggccgacctcaacagcacc

SEQ ID NO: 4223 - DNA, 36 bp, Homo sapiens
gagaggcgggttaggaagagtggagactgctgcacg

SEQ ID NO: 4224 - DNA, 36 bp, Homo sapiens
ctccaggctcaagtccaggagtttgatgaaaatgat

SEQ ID NO: 4225 - DNA, 36 bp, Homo sapiens
cggccaccccgctctccagtcagtcactgccccagc

SEQ ID NO: 4226 - DNA, 500 bp, Homo sapiens
gaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaac

SEQ ID NO: 4227 - DNA, 36 bp, Homo sapiens
gagccctacctcctcacgatggccaaaaaggctttg

SEQ ID NO: 4228 - DNA, 500 bp, Homo sapiens
cagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaag

SEQ ID NO: 4229 - DNA, 216 bp, Homo sapiens
gctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgcc

SEQ ID NO: 4230 - DNA, 500 bp, Homo sapiens
aggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaa

SEQ ID NO: 4231 - DNA, 152 bp, Homo sapiens
gtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaa

SEQ ID NO: 4232 - DNA, 36 bp, Homo sapiens
ccctgtgttgcactccagtgcggccatgctgaaaat

SEQ ID NO: 4233 - DNA, 50 bp, Homo sapiens
ggatgatctccatctcctgacctcgtgatccacccgcctcggcctcccaa

SEQ ID NO: 4234 - DNA, 36 bp, Homo sapiens
tgcacaacagccctggagcccacctgcttccagaca

SEQ ID NO: 4235 - DNA, 500 bp, Homo sapiens
tcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggat

SEQ ID NO: 4236 - DNA, 36 bp, Homo sapiens
ggacacatgcctcctctgacttcagcccagcaggca

SEQ ID NO: 4237 - DNA, 36 bp, Homo sapiens
gcaatgaaacgacttcaggctgctggcaacgcagtg

SEQ ID NO: 4238 - DNA, 36 bp, Homo sapiens
cccagcaggcacccggccagaaggagtgtgataacg

SEQ ID NO: 4239 - DNA, 69 bp, Homo sapiens
cagatgagtgagattgaggccaaggtccgctacgtgaagctagcccgttctctcaagacttacggtgtc

SEQ ID NO: 4240 - DNA, 66 bp, Homo sapiens
gatggctattactcagtacagacaactgaaggggagcagattgcacagctcattgccggctacatc

SEQ ID NO: 4241 - DNA, 498 bp, Homo sapiens
gaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccga

SEQ ID NO: 4242 - DNA, 500 bp, Homo sapiens
gagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaa

SEQ ID NO: 4243 - DNA, 500 bp, Homo sapiens
ctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcct

SEQ ID NO: 4244 - DNA, 500 bp, Homo sapiens
tgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaagg

SEQ ID NO: 4245 - DNA, 90 bp, Homo sapiens
gtgaaagatgtagccaaagccctgggagacctcatcagtgcaacgaaggctgcagctggcaaagttggagatgaccctgctgtgtggcag

SEQ ID NO: 4246 - DNA, 500 bp, Homo sapiens
gaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcct

SEQ ID NO: 4247 - DNA, 90 bp, Homo sapiens
aactttgaggagcagatactagaagctgccaagtccattgcagcagccaccagtgcactggtaaaggctgcgtcggctgcccagagagaa

SEQ ID NO: 4248 - DNA, 500 bp, Homo sapiens
aatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctattt

SEQ ID NO: 4249 - DNA, 147 bp, Homo sapiens
gccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggag

SEQ ID NO: 4250 - DNA, 500 bp, Homo sapiens
aggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggag

SEQ ID NO: 4251 - DNA, 500 bp, Homo sapiens
atcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccct

SEQ ID NO: 4252 - DNA, 36 bp, Homo sapiens
gggcgcaccactggcattgtcatggactctggagac

SEQ ID NO: 4253 - DNA, 500 bp, Homo sapiens
gggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccc

SEQ ID NO: 4254 - DNA, 36 bp, Homo sapiens
ccaactgggacgacatggagaagatctggcaccaca

SEQ ID NO: 4255 - DNA, 80 bp, Homo sapiens
gctggactgcagtgacacaatctcggctgactgcaaccactgcctccagggttcaagcgattctcttgcctcagcctccc

SEQ ID NO: 4256 - DNA, 36 bp, Homo sapiens
tgcatgttggtgaaggaagaagtggggtggaagaag

SEQ ID NO: 4257 - DNA, 254 bp, Homo sapiens
cgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactt

SEQ ID NO: 4258 - DNA, 36 bp, Homo sapiens
atcgcggggcccggagaggtgttggagagcacaatg

SEQ ID NO: 4259 - DNA, 146 bp, Homo sapiens
ggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaa

SEQ ID NO: 4260 - DNA, 500 bp, Homo sapiens
aagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccat

SEQ ID NO: 4261 - DNA, 36 bp, Homo sapiens
aaacagagagatgcaaaagggcgagaggtcaatgat

SEQ ID NO: 4262 - DNA, 36 bp, Homo sapiens
gtggagccattgacgcagttcatgtgggtgtatgat

SEQ ID NO: 4263 - DNA, 102 bp, Homo sapiens
gtttttattaattgccttattgaaaatccaacttttgattctcagactaaggaaaacatgactctgcagcccaaaagttttgggtctaaatgccagctgtca

SEQ ID NO: 4264 - DNA, 500 bp, Homo sapiens
agtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtaca

SEQ ID NO: 4265 - DNA, 36 bp, Homo sapiens
cctgaaaacaacgttctgtcccccttgccgtcccaa

SEQ ID NO: 4266 - DNA, 36 bp, Homo sapiens
aagtctgtgacttgcacgtactcccctgccctcaac

SEQ ID NO: 4267 - DNA, 85 bp, Homo sapiens
tcccccttgccgtcccaagcaatggatgatttgatgctgtccccggacgatattgaacaatggttcactgaagacccaggtccag

SEQ ID NO: 4268 - DNA, 325 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaact

SEQ ID NO: 4269 - DNA, 500 bp, Homo sapiens
aagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaa

SEQ ID NO: 4270 - DNA, 36 bp, Homo sapiens
cgcaatattgccattcagagccaatttacaagaaca

SEQ ID NO: 4271 - DNA, 36 bp, Homo sapiens
tacaagtagcagccccagtgactgtatttactgaga

SEQ ID NO: 4272 - DNA, 500 bp, Homo sapiens
cgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagct

SEQ ID NO: 4273 - DNA, 500 bp, Homo sapiens
agtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaat

SEQ ID NO: 4274 - DNA, 500 bp, Homo sapiens
atcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaa

SEQ ID NO: 4275 - DNA, 500 bp, Homo sapiens
aagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatct

SEQ ID NO: 4276 - DNA, 162 bp, Homo sapiens
gaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaag

SEQ ID NO: 4277 - DNA, 500 bp, Homo sapiens
atcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagta

SEQ ID NO: 4278 - DNA, 500 bp, Homo sapiens
tgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggct

SEQ ID NO: 4279 - DNA, 149 bp, Homo sapiens
ctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggag

SEQ ID NO: 4280 - DNA, 36 bp, Homo sapiens
cccacttctcacccacaggtaacacgtacacagacc

SEQ ID NO: 4281 - DNA, 36 bp, Homo sapiens
gtggcgacaaagcctccggccgtcactatggggctg

SEQ ID NO: 4282 - DNA, 165 bp, Homo sapiens
acaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctc

SEQ ID NO: 4283 - DNA, 276 bp, Homo sapiens
gttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacaga

SEQ ID NO: 4284 - DNA, 36 bp, Homo sapiens
ttggatcttgctgtggttttgtttgaaacagcaacg

SEQ ID NO: 4285 - DNA, 81 bp, Homo sapiens
atttcaaatgcttctgatgctttagataagataaggctaatatcactgactgatgaaaatgctctttctggaaatgaggaa

SEQ ID NO: 4286 - DNA, 500 bp, Homo sapiens
ctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagc

SEQ ID NO: 4287 - DNA, 500 bp, Homo sapiens
agcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacg

SEQ ID NO: 4288 - DNA, 500 bp, Homo sapiens
tttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctagg

SEQ ID NO: 4289 - DNA, 500 bp, Homo sapiens
gttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagc

SEQ ID NO: 4290 - DNA, 210 bp, Homo sapiens
gttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagat

SEQ ID NO: 4291 - DNA, 500 bp, Homo sapiens
acacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacggg

SEQ ID NO: 4292 - DNA, 36 bp, Homo sapiens
atgctgggacatctgctggtgcatttaaaaaatgat

SEQ ID NO: 4293 - DNA, 500 bp, Homo sapiens
tgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaa

SEQ ID NO: 4294 - DNA, 39 bp, Homo sapiens
gtatgtcctgaagctgagcaagactgtccttttaagcac

SEQ ID NO: 4295 - DNA, 500 bp, Homo sapiens
ctaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaa

SEQ ID NO: 4296 - DNA, 36 bp, Homo sapiens
aagagaacctcaattctgaccgtggccctatgcttg

SEQ ID NO: 4297 - DNA, 36 bp, Homo sapiens
caagagccacatgacaagcacctcttggacaggatt

SEQ ID NO: 4298 - DNA, 500 bp, Homo sapiens
ggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgac

SEQ ID NO: 4299 - DNA, 425 bp, Homo sapiens
gaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaag

SEQ ID NO: 4300 - DNA, 322 bp, Homo sapiens
acgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtcttta

SEQ ID NO: 4301 - DNA, 117 bp, Homo sapiens
aacgaatatgtgggcaaagccgccactcgtttatccatcctctcgttactgggtcatgtcataagactgcagccatcttggaagcataagctctctcaagcacctcttttgccttct

SEQ ID NO: 4302 - DNA, 69 bp, Homo sapiens
aaggttctgtcactctaagtgatcttccagggtttttaggtgatctggcctctgaagaagatagtattg

SEQ ID NO: 4303 - DNA, 500 bp, Homo sapiens
caagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggat

SEQ ID NO: 4304 - DNA, 500 bp, Homo sapiens
aggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttgga

SEQ ID NO: 4305 - DNA, 500 bp, Homo sapiens
gtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggca

SEQ ID NO: 4306 - DNA, 36 bp, Homo sapiens
ccgtctgtgtcctcccagactccgccgtggtcatgg

SEQ ID NO: 4307 - DNA, 271 bp, Homo sapiens
aggctggagtgcagcggcgcgatctcggctcactgcaagctccgcctcccgggttcacgccattctcctgcctcagcctcccgagcagctggtactacaggtgcctgccaccacgcctggctaatgttttgtatttttagtagagacggggtttcaccgtgttagccaggatggtcttgatctcctgacctcgtgatctgcccacctcggcctcctaaagtgctgggattacaggcgtcagccaccgcgcccggtcgatataatccatgtt

SEQ ID NO: 4308 - DNA, 36 bp, Homo sapiens
catagtagcatgtgccaggtgagcctatttccacaa

SEQ ID NO: 4309 - DNA, 36 bp, Homo sapiens
cctggtatccgctaacaggtcaaaatgcagatcttc

SEQ ID NO: 4310 - DNA, 223 bp, Homo sapiens
gccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctgga

SEQ ID NO: 4311 - DNA, 422 bp, Homo sapiens
aggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataa

SEQ ID NO: 4312 - DNA, 36 bp, Homo sapiens
gcaagaccatcaccctggaagtggagcccagtgaca

SEQ ID NO: 4313 - DNA, 36 bp, Homo sapiens
gcaagaccatcactctggaggtggagcccagtgaca

SEQ ID NO: 4314 - DNA, 191 bp, Homo sapiens
tcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaaga

SEQ ID NO: 4315 - DNA, 25 bp, Homo sapiens
aggccaagatccaagataaagaagg

SEQ ID NO: 4316 - DNA, 54 bp, Homo sapiens
tgcagatcttcgtgaaaacccttaccggcaagaccatcacccttgaggtggagc

SEQ ID NO: 4317 - DNA, 167 bp, Homo sapiens
ggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcag

SEQ ID NO: 4318 - DNA, 36 bp, Homo sapiens
aagaccatcaccctcgaggtggagcccagtgacacc

SEQ ID NO: 4319 - DNA, 36 bp, Homo sapiens
ggtaagaccatcaccctcgaggtggagcccagtgac

SEQ ID NO: 4320 - DNA, 419 bp, Homo sapiens
gctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattc

SEQ ID NO: 4321 - DNA, 36 bp, Homo sapiens
caaatcttcgtgaagacactcactggcaagaccatc

SEQ ID NO: 4322 - DNA, 36 bp, Homo sapiens
ctggcaagaccatcacccttgaggtcgagcccagtg

SEQ ID NO: 4323 - DNA, 36 bp, Homo sapiens
ccaccttgcacctggtactccgtctcagaggtggga

SEQ ID NO: 4324 - DNA, 25 bp, Homo sapiens
accttgcacctggtactccgtctca

SEQ ID NO: 4325 - DNA, 36 bp, Homo sapiens
taagaccatcaccctcgaggtggagcccagtgacac

SEQ ID NO: 4326 - DNA, 36 bp, Homo sapiens
gcccaggaagtcatgaaggtcagcacgggtggggag

SEQ ID NO: 4327 - DNA, 36 bp, Homo sapiens
aacttccctcctgaccagctcacaagctcaggagcg

SEQ ID NO: 4328 - DNA, 36 bp, Homo sapiens
ggaacggttggatcagccgatgacagagattgtgag

SEQ ID NO: 4329 - DNA, 36 bp, Homo sapiens
gctcccctgcccagtccgtgttgtccgaagtgccct

SEQ ID NO: 4330 - DNA, 25 bp, Homo sapiens
gagattgtgagccgtgtgtcgaagc

SEQ ID NO: 4331 - DNA, 54 bp, Homo sapiens
gctggtgcttgagctgtgctgtaacgacgagagcggcgaggatgtcgaggttcc

SEQ ID NO: 4332 - DNA, 37 bp, Homo sapiens
ttagagatcaccatgctgtcccagggcgtgtccatgc

SEQ ID NO: 4333 - DNA, 500 bp, Homo sapiens
ggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgca

SEQ ID NO: 4334 - DNA, 500 bp, Homo sapiens
gctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgca

SEQ ID NO: 4335 - DNA, 500 bp, Homo sapiens
agtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccc

SEQ ID NO: 4336 - DNA, 154 bp, Homo sapiens
gtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcaga

SEQ ID NO: 4337 - DNA, 500 bp, Homo sapiens
aagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgata

SEQ ID NO: 4338 - DNA, 36 bp, Homo sapiens
catgcgggatttcaagcggtaagggccttcaccttc

SEQ ID NO: 4339 - DNA, 36 bp, Homo sapiens
ggacaccttttgaagatggtaagtcatactcattat

SEQ ID NO: 4340 - DNA, 172 bp, Homo sapiens
tgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatct

SEQ ID NO: 4341 - DNA, 213 bp, Homo sapiens
aggctggagtacaattgtgcgatcttggctcactgcaacctctgcctcccggcttcaagtgattctcctgcctcaacctcccgagtagctgggattacaggcacctgccatcatgcccagttaatttttgtatttttgtagagacggggtttcacaatggccaggctggtctcgaactcctgaccttagttgatccgcccggctcggcctccc

SEQ ID NO: 4342 - DNA, 36 bp, Homo sapiens
acaccaagggctctgagcatgccagcattgggagcc

SEQ ID NO: 4343 - DNA, 36 bp, Homo sapiens
aagccaacctcatgacagatgacctcccttgccact

SEQ ID NO: 4344 - DNA, 25 bp, Homo sapiens
cccttgccacttcacttctgccttt

SEQ ID NO: 4345 - DNA, 85 bp, Homo sapiens
tcgcctcccctgtagacgtggtcaagacgagatacatgaactctgccctgggccagtacagtagcgctggccactgtgcccttac

SEQ ID NO: 4346 - DNA, 500 bp, Homo sapiens
gggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctccc

SEQ ID NO: 4347 - DNA, 500 bp, Homo sapiens
gcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtg

SEQ ID NO: 4348 - DNA, 500 bp, Homo sapiens
ctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctctt

SEQ ID NO: 4349 - DNA, 500 bp, Homo sapiens
ggccacagatgtgccccctactgccactgtgaagtttcttggggctggcacagctgcctgcatcgcagatctcatcacctttcctctggatactgctaaagtccggttacagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggt

SEQ ID NO: 4350 - DNA, 500 bp, Homo sapiens
tcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgt

SEQ ID NO: 4351 - DNA, 145 bp, Homo sapiens
tcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggcc

SEQ ID NO: 4352 - DNA, 433 bp, Homo sapiens
ccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttgg

SEQ ID NO: 4353 - DNA, 36 bp, Homo sapiens
tgctaaaggaagaggaagatcttagcaaagcaatgt

SEQ ID NO: 4354 - DNA, 336 bp, Homo sapiens
ctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaa

SEQ ID NO: 4355 - DNA, 36 bp, Homo sapiens
tggctggtaagcaggccgtttcagcatcaggcaagt

SEQ ID NO: 4356 - DNA, 36 bp, Homo sapiens
tggaccaaatatgaagaggtctttgctgttccagct

SEQ ID NO: 4357 - DNA, 55 bp, Homo sapiens
gtccaggctgatcttggactcctgctctcaagcaatcctcctgcctcagcctgcc

SEQ ID NO: 4358 - DNA, 36 bp, Homo sapiens
gcgtcgagctgcaggaaggtgacataccgcgtagtc

SEQ ID NO: 4359 - DNA, 36 bp, Homo sapiens
ttttgagcttcatttcaggctcctgtggctgtcttg

SEQ ID NO: 4360 - DNA, 500 bp, Homo sapiens
agaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgg

SEQ ID NO: 4361 - DNA, 500 bp, Homo sapiens
acaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcggcttcctgacaagaaatccataattatgtatttaacatctttgtt

SEQ ID NO: 4362 - DNA, 500 bp, Homo sapiens
gagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaa

SEQ ID NO: 4363 - DNA, 168 bp, Homo sapiens
gagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagac

SEQ ID NO: 4364 - DNA, 36 bp, Homo sapiens
cgcccccagatgtcccaggtgagccctccgcgggca

SEQ ID NO: 4365 - DNA, 467 bp, Homo sapiens
acgcctccggagcgggaccaggtcccaagatggtggccatgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaa

SEQ ID NO: 4366 - DNA, 36 bp, Homo sapiens
aagtccccagttgccaaggcaggtgcaagatcatgg

SEQ ID NO: 4367 - DNA, 96 bp, Homo sapiens
aatgaagtagggtatgatgacattggtggctgcaggaagcagctagctcagatcaaagagatggtggaactgcccctgagacatcctgccctcttt

SEQ ID NO: 4368 - DNA, 500 bp, Homo sapiens
tatcaaacgagaggatgaggaagagtccttgaatgaagtagggtatgatgacattggtggctgcaggaagcagctagctcagatcaaagagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacc

SEQ ID NO: 4369 - DNA, 500 bp, Homo sapiens
gacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgc

SEQ ID NO: 4370 - DNA, 36 bp, Homo sapiens
ccctgttctgttttgtaggactttgtgttttatgcc

SEQ ID NO: 4371 - DNA, 130 bp, Homo sapiens
tttgccaggctagtctcgaactcctgaactcaagtgatccacccgtcttggcctcccaaagtgctgggattacaagtgtgagccaccacgctcagcttgcagccttcccccatcccttttgggtgagtgg

SEQ ID NO: 4372 - DNA, 36 bp, Homo sapiens
tctgcccaccccacacaggaagctccactgcacgcg

SEQ ID NO: 4373 - DNA, 36 bp, Homo sapiens
acatactcatcggctggggtgctgggacaccatcaa

SEQ ID NO: 4374 - DNA, 36 bp, Homo sapiens
agcagcagcgagacccctaatcgccacgacatgctc

SEQ ID NO: 4375 - DNA, 286 bp, Homo sapiens
ctcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattt

SEQ ID NO: 4376 - DNA, 500 bp, Homo sapiens
cagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcact

SEQ ID NO: 4377 - DNA, 500 bp, Homo sapiens
accgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacag

SEQ ID NO: 4378 - DNA, 36 bp, Homo sapiens
ggaggatgcctccgacctctgcttccctgacatctc

SEQ ID NO: 4379 - DNA, 36 bp, Homo sapiens
gtcattgagactgtccaggtgagctttgccagcccg

SEQ ID NO: 4380 - DNA, 177 bp, Homo sapiens
ctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttcc

SEQ ID NO: 4381 - DNA, 36 bp, Homo sapiens
cgccgcctcctacttcggcctgaccgggcgggaagt

SEQ ID NO: 4382 - DNA, 311 bp, Homo sapiens
cgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattccc

SEQ ID NO: 4383 - DNA, 36 bp, Homo sapiens
ggccacggccgcctgcaggtggagatcaccattcaa

SEQ ID NO: 4384 - DNA, 500 bp, Homo sapiens
tcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggg

SEQ ID NO: 4385 - DNA, 36 bp, Homo sapiens
tccaatgatccacagatggtcgctgaaaattttgtt

SEQ ID NO: 4386 - DNA, 36 bp, Homo sapiens
agttggttcaatctctggtaatctatgccagcaatt

SEQ ID NO: 4387 - DNA, 36 bp, Homo sapiens
ggaatgtcgcagatacgggcttacagatacttttta

SEQ ID NO: 4388 - DNA, 500 bp, Homo sapiens
gaaaataggctggccatggtggcttacacctgtaatcccagcacttcagaaggccaaggcgggcggatgacctgaggtcgggagttcaagaccagcctgcctaacgtggcaaaaccccatctctattaaaaatacaaaaatggccaggcgtggtggctcaacacctgtaatcccaacactttgagaggccgaggccggtggatcacctgaggtcaggatttcaagaccagcctgaccaacatggtgaaaccccatctctactcaaagattaggctgggtgccgtggctcacgcttgtaatcccagcactttgggaggccgaggtgggcagatcacgaggtcaggagatggagaccatggtgaaaccctgtctctactaaaaatacaaaaaattatccgggtgtggtggtgggcgcctgtagtcccagctactcggagaggctgaggcaggagaatggcatgaacccgggaggcggagcttgcagtgagccaagatcgcgc

SEQ ID NO: 4389 - DNA, 304 bp, Homo sapiens
attatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagct

SEQ ID NO: 4390 - DNA, 500 bp, Homo sapiens
atgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattct

SEQ ID NO: 4391 - DNA, 270 bp, Homo sapiens
atgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattctt

SEQ ID NO: 4392 - DNA, 174 bp, Homo sapiens
atgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaaga

SEQ ID NO: 4393 - DNA, 66 bp, Homo sapiens
gtactgacacatttaaaggagcatcctgatgcttggacaagagtcgacacaattttggaattttct

SEQ ID NO: 4394 - DNA, 500 bp, Homo sapiens
tttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaa

SEQ ID NO: 4395 - DNA, 146 bp, Homo sapiens
attatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgattt

SEQ ID NO: 4396 - DNA, 36 bp, Homo sapiens
ttgagggggtacagtcagaaggacaggacaatgggg

SEQ ID NO: 4397 - DNA, 290 bp, Homo sapiens
acttctttctttacggggagttccctggggacgagcggcggaaactcatccgatacgtcacagccttcaatggggagctcgaggactatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacaca

SEQ ID NO: 4398 - DNA, 74 bp, Homo sapiens
caggacctagctatgcagctgctaccctccaggcttctagtgctgcctcctcagcctctccagtctccagggcc

SEQ ID NO: 4399 - DNA, 92 bp, Homo sapiens
tcacagccagcgacccggcaggacctagctatgcagctgctaccctccaggcttctagtgctgcctcctcagcctctccagtctccagggcc

SEQ ID NO: 4400 - DNA, 500 bp, Homo sapiens
cttggccagttccgtgtgaaggaggaggatgagagcgccaactctctgaggccgggggctctcttcttcagccggatcaacaagacatccccagtcacagccagcgacccggcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctc

SEQ ID NO: 4401 - DNA, 36 bp, Homo sapiens
gatgagaaggtgctgcaggagctagacatgagtgat

SEQ ID NO: 4402 - DNA, 36 bp, Homo sapiens
aggttcaaccgcgccctgaactgcatgaacttgccc

SEQ ID NO: 4403 - DNA, 36 bp, Homo sapiens
gagcccccagcacccaagtcaccgccaaaggcccgg

SEQ ID NO: 4404 - DNA, 36 bp, Homo sapiens
gagctcatctgtgatcaggagcggtttcaagtcaag

SEQ ID NO: 4405 - DNA, 45 bp, Homo sapiens
gcagcccgcgggccccgccgcgccgccccccaagcagcccgcgcc

SEQ ID NO: 4406 - DNA, 106 bp, Homo sapiens
ggagaggttcaaccgcgccctgaactgcatgaacttgcccccagacaaggtccagctgctgagccagtatgacaacgagaagaagtgggagctcatctgtgatcag

SEQ ID NO: 4407 - DNA, 36 bp, Homo sapiens
ttgaagacatcatcacagatctgcggaaccagccct

SEQ ID NO: 4408 - DNA, 75 bp, Homo sapiens
acatccgcgcagacacaggccgccgcagtgcccgtcggcgtcccccgggccccccactgcaggtcacctccgacc

SEQ ID NO: 4409 - DNA, 395 bp, Homo sapiens
cggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgg

SEQ ID NO: 4410 - DNA, 500 bp, Homo sapiens
gacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggaga

SEQ ID NO: 4411 - DNA, 500 bp, Homo sapiens
agccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccag

SEQ ID NO: 4412 - DNA, 500 bp, Homo sapiens
ctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaat

SEQ ID NO: 4413 - DNA, 500 bp, Homo sapiens
cggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcag

SEQ ID NO: 4414 - DNA, 36 bp, Homo sapiens
atgtttgtacagcgacaggtaagtttcagattgaca

SEQ ID NO: 4415 - DNA, 78 bp, Homo sapiens
atggacgtgggctttaccatgagtaactccattcctggtatagaatccccatttgaacaagcaaagaaggtgataacc

SEQ ID NO: 4416 - DNA, 36 bp, Homo sapiens
aggctgagcgatacgacgaaatggtggagtcaatga

SEQ ID NO: 4417 - DNA, 25 bp, Homo sapiens
gtgccagatgtggcaagatcaccat

SEQ ID NO: 4418 - DNA, 365 bp, Homo sapiens
agaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagccta

SEQ ID NO: 4419 - DNA, 156 bp, Homo sapiens
gattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctcca

SEQ ID NO: 4420 - DNA, 148 bp, Homo sapiens
catagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtc

SEQ ID NO: 4421 - DNA, 500 bp, Homo sapiens
gaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggg

SEQ ID NO: 4422 - DNA, 36 bp, Homo sapiens
gctggggagtttgttgggtgaactttgaggcgctga

SEQ ID NO: 4423 - DNA, 54 bp, Homo sapiens
gcctgtttaaagaagaaaacccgtatgctagatttgaaaacaactaaagcgctc

SEQ ID NO: 4424 - DNA, 126 bp, Homo sapiens
acccgtatgctagatttgaaaacaactaaagcgctccagcacatcagtcccgacgcttcctgtgaggtgcacgctccgcagcccagcccagccgggagaccacgtggccattgcggtctcctgacc

SEQ ID NO: 4425 - DNA, 61 bp, Homo sapiens
gtgtcggccaggctggtctcaaaccccctgagttcaggtgatccacctgcctcagcctcgc

SEQ ID NO: 4426 - DNA, 376 bp, Homo sapiens
cccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtt

SEQ ID NO: 4427 - DNA, 134 bp, Homo sapiens
gcccaggctggagtgcagtggcgctatccctgattcaagcgattctcctgccttagcctcccgagtagctgcgattacaggcacctgccaccacacccagctcatttttgtatttttttagtagagacggggtt

SEQ ID NO: 4428 - DNA, 95 bp, Homo sapiens
cgcccaggctggagtgcaatggcgtgatctcggctcactgcaacctccgcctcccagattcaattgattttcctgtctcagcttcccaagtagct

SEQ ID NO: 4429 - DNA, 36 bp, Homo sapiens
gagcagtccgctacggagctccagcccttctctgag

SEQ ID NO: 4430 - DNA, 206 bp, Homo sapiens
ggtctaaactggaaatacataaagacaccttattgtattcgtggaagctcagagtgtgaccaactggaaccctcaagaggaccgagatttgccagtttttcagttgggcatatacagaaactccatttctgaatttccctgctgttccctcccagcccccactctttgctgttgcttagaatgcagatgtgatgactagagccatc

SEQ ID NO: 4431 - DNA, 82 bp, Homo sapiens
aggctaaagtgcagtggtgtcacctcggctcactgcaacctccacttcccaggttcaagcaattctcctgcctcagccttcc

SEQ ID NO: 4432 - DNA, 127 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccga

SEQ ID NO: 4433 - DNA, 36 bp, Homo sapiens
agaggagcccggggccaggcagcctgccctacgagt

SEQ ID NO: 4434 - DNA, 464 bp, Homo sapiens
aggctggagtgcagtggtgcgatctcggcttactgcaacctctgcctcccgagttcaagcgatcctcctgcctccgcctcccgaatagctgggactacaggcatgtgtcccaaggcttggctgatttttgtatttttagtagagacagagtttcgccatgttggccaggctggtctcgaacgcctgatctcaggcagtccgccaacctcagcctcccaaagtgctgggattacgggcgtgagccactgtgtgcccagcctttgtttacattttcaagactatgccctggaaaaatactgggctgtttggaacacagcctttgagcttgtaacttcaagccgttgtttaagaaaatcatttctgtttatcctaggtgagaactgaggtatccttagctgctggaggtaattttatttaaagtggatggtatgtcagtatgtttttcagcccatattcacccagag

SEQ ID NO: 4435 - DNA, 109 bp, Homo sapiens
gatgtggctgtggatttcacccaggatgagtggaggctgctgagccctgctcaaaggactctgtacagagaggtgatgctggagaactacagcaacctggtctcactgg

SEQ ID NO: 4436 - DNA, 36 bp, Homo sapiens
gagttcgagtttctggagaaagcatcaaaactgcga

SEQ ID NO: 4437 - DNA, 63 bp, Homo sapiens
gctcacatccgaactcaacatctctcaaggccaaggtgctggagaccttcctggccaagtcca

SEQ ID NO: 4438 - DNA, 199 bp, Homo sapiens
gatagcgggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcg

SEQ ID NO: 4439 - DNA, 36 bp, Homo sapiens
gaggcatcggaggaggaaagagaaccagggctccgg

SEQ ID NO: 4440 - DNA, 36 bp, Homo sapiens
cccatctgtctccaacagccttcgccgcctgtgcca

SEQ ID NO: 4441 - DNA, 36 bp, Homo sapiens
ccccactctctgtggcagaggcaaatacctcctcta

SEQ ID NO: 4442 - DNA, 36 bp, Homo sapiens
tggtcacacctcacaagtccacggacctcaccgtgg

SEQ ID NO: 4443 - DNA, 36 bp, Homo sapiens
acaccgatgtggacacaggtgggcagccctgtggtg

SEQ ID NO: 4444 - DNA, 36 bp, Homo sapiens
gctttgaagaggggacaggtaggtccacggagcatg

SEQ ID NO: 4445 - DNA, 500 bp, Homo sapiens
tttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgc

SEQ ID NO: 4446 - DNA, 500 bp, Homo sapiens
gcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatgg

SEQ ID NO: 4447 - DNA, 500 bp, Homo sapiens
tttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaaga

SEQ ID NO: 4448 - DNA, 349 bp, Homo sapiens
ctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcagg

SEQ ID NO: 4449 - DNA, 104 bp, Homo sapiens
ttcattggaattttttgtttcgaggctggaattaaaatcattgcccttgggtttgccttccacaaaggctcctacttgaggaatggctggaatgtcatggactt

SEQ ID NO: 4450 - DNA, 500 bp, Homo sapiens
atgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactt

SEQ ID NO: 4451 - DNA, 500 bp, Homo sapiens
agtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaa

SEQ ID NO: 4452 - DNA, 500 bp, Homo sapiens
gggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagc

SEQ ID NO: 4453 - DNA, 500 bp, Homo sapiens
ctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctc

SEQ ID NO: 4454 - DNA, 500 bp, Homo sapiens
ggaacgggtggagaaccggcgggcttttctgaagctgaggcggcaacaacagattgaacgtgagctcaatgggtacatggaatggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaa

SEQ ID NO: 4455 - DNA, 80 bp, Homo sapiens
ggaacgggtggagaaccggcgggcttttctgaagctgaggcggcaacaacagattgaacgtgagctcaatgggtacatgg

SEQ ID NO: 4456 - DNA, 500 bp, Homo sapiens
aggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaa

SEQ ID NO: 4457 - DNA, 500 bp, Homo sapiens
tggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacac

SEQ ID NO: 4458 - DNA, 500 bp, Homo sapiens
ttacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttcc

SEQ ID NO: 4459 - DNA, 500 bp, Homo sapiens
ccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcat

SEQ ID NO: 4460 - DNA, 80 bp, Homo sapiens
atcgacgtggaggacgaggacagtgatgaagatgagttccaaatcactgagcacaataacttccggaccttcttccaggc

SEQ ID NO: 4461 - DNA, 74 bp, Homo sapiens
ttccagcgcatggagcccccgtccccaacgcaggaagggggacctggccagaacgccctcccctccacccagct

SEQ ID NO: 4462 - DNA, 500 bp, Homo sapiens
cgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggta

SEQ ID NO: 4463 - DNA, 218 bp, Homo sapiens
gcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagag

SEQ ID NO: 4464 - DNA, 36 bp, Homo sapiens
caggattggtactacaaggctgcaaggtgtgactgt

SEQ ID NO: 4465 - DNA, 500 bp, Homo sapiens
gacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaact

SEQ ID NO: 4466 - DNA, 500 bp, Homo sapiens
ttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcat

SEQ ID NO: 4467 - DNA, 137 bp, Homo sapiens
aacaggattttgccagacgtttaggattgagatgtgttacttgcaactattgttctcagctatgtaagaagggagcaactaaagaactcgatggtgttgtgagagatttctgcagtgaagattgctgtaaaaaattt

SEQ ID NO: 4468 - DNA, 36 bp, Homo sapiens
tgcctggaatgccaccaggtatgcccccacctgttc

SEQ ID NO: 4469 - DNA, 36 bp, Homo sapiens
tttcctagcacagcacaagctcaggcagctgtccaa

SEQ ID NO: 4470 - DNA, 36 bp, Homo sapiens
gccaggcatgccacctggattgcatcatcagagaaa

SEQ ID NO: 4471 - DNA, 49 bp, Homo sapiens
atgccacctggaccaggaataccacctctgatgcctggaatgccaccag

SEQ ID NO: 4472 - DNA, 55 bp, Homo sapiens
gcatacctccattaatgccaggtgttcctcctctgatgccaggaatgccaccagt

SEQ ID NO: 4473 - DNA, 500 bp, Homo sapiens
aacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattca

SEQ ID NO: 4474 - DNA, 435 bp, Homo sapiens
gagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttc

SEQ ID NO: 4475 - DNA, 122 bp, Homo sapiens
cacgtcctggaattcctccaatgactcaagcacaggctgtttcagcgccaggtattcttaatagaccacctgcaccaacagcaactgtacctgccccacagcctccagttactaagcctctt

SEQ ID NO: 4476 - DNA, 36 bp, Homo sapiens
cacgagcgaaatgacaagccacatcgatgtgaccag

SEQ ID NO: 4477 - DNA, 186 bp, Homo sapiens
ttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacag

SEQ ID NO: 4478 - DNA, 36 bp, Homo sapiens; identical to SEQ ID NO: 4476

SEQ ID NO: 4479 - DNA, 500 bp, Homo sapiens
taggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatg

SEQ ID NO: 4480 - DNA, 34 bp, Homo sapiens
gaagagcgagccagcgcccggagcaagcggagct

SEQ ID NO: 4481 - DNA, 36 bp, Homo sapiens
ccaacggaatcaccctgggtgagccctgcctttcct

SEQ ID NO: 4482 - DNA, 36 bp, Homo sapiens
acctcaatcagagatccgtgtgctggtccagtttgt

SEQ ID NO: 4483 - DNA, 36 bp, Homo sapiens
gaatgtgtgaaagatcagtttggcttcattaactat

SEQ ID NO: 4484 - DNA, 85 bp, Homo sapiens
gaagtaggagatagcaagaagctctttttccatgtgaaagaagttcaggatggcattgagctacaggcaggagatgaggtggagt

SEQ ID NO: 4485 - DNA, 177 bp, Homo sapiens
cgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcact

SEQ ID NO: 4486 - DNA, 500 bp, Homo sapiens
gacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggcca

SEQ ID NO: 4487 - DNA, 500 bp, Homo sapiens
ggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatga

SEQ ID NO: 4488 - DNA, 62 bp, Homo sapiens
gaccacggctcactgcagctttgacctccttggctcaggtgatccttcgacctctgcctccc

SEQ ID NO: 4489 - DNA, 57 bp, Homo sapiens
ttggccaggctggtctcgaattcctgacctcaagtgatctgcccaccttgacctccc

SEQ ID NO: 4490 - DNA, 81 bp, Homo sapiens
ccacgttggcctttgtcctggccgtcactggcaacctgacgctggtgctggcccagaggagggacccctccatccactaca

SEQ ID NO: 4491 - DNA, 36 bp, Homo sapiens
gagagtgacaaggccgcggtcctggaccggatcaaa

SEQ ID NO: 4492 - DNA, 500 bp, Homo sapiens
agttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagcc

SEQ ID NO: 4493 - DNA, 500 bp, Homo sapiens
tgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaagg

SEQ ID NO: 4494 - DNA, 143 bp, Homo sapiens
ccaccacccggattcatagtgtgaattcctgcccggccctgagtcatacccaggcaagtgctttctctggagaaacacttgccgtccttacagcaggaatctccaagagatggcccaagtatcggcttcccatcgatattgct

SEQ ID NO: 4495 - DNA, 488 bp, Homo sapiens
caagctgtagtgctgctgggaagcatcagtggggtttgtcggcagctcccttggtgcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttc

SEQ ID NO: 4496 - DNA, 500 bp, Homo sapiens
aggtgcttgagtttcacctttctccagtccagcagaattacattttgatgacctccattttgatacttgtagaccagatctaatccgaagattaatctttaggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctact

SEQ ID NO: 4497 - DNA, 500 bp, Homo sapiens
aagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcagg

SEQ ID NO: 4498 - DNA, 500 bp, Homo sapiens
acttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatag

SEQ ID NO: 4499 - DNA, 36 bp, Homo sapiens
ctcaagcgatcctcccacctgtcctcccaaagtgct

SEQ ID NO: 4500 - DNA, 36 bp, Homo sapiens
ctcaagcgatcctcccacctgtaatcccagcacttt

SEQ ID NO: 4501 - DNA, 36 bp, Homo sapiens
ccacagattcatcctcagctcaccgggattattcaa

SEQ ID NO: 4502 - DNA, 41 bp, Homo sapiens
caccggccccagggccctgccgcctgggcctccacacccat

SEQ ID NO: 4503 - DNA, 292 bp, Homo sapiens
caatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtatta

SEQ ID NO: 4504 - DNA, 36 bp, Homo sapiens
tccaaatttgatggcaaggcgcggtggctcacgcct

SEQ ID NO: 4505 - DNA, 118 bp, Homo sapiens
tcggcccctgctgcggagggggagggaacccccacccagcccgcgtccgagaaagaacccgaaatgcccggtcccagagaggagagcgaggaggaagaggacgaggacgacgaggagg

SEQ ID NO: 4506 - DNA, 118 bp, Homo sapiens
atgttggtcacgctggtcttgaactcccgacctcaggtgatctgcctcaggcccgcctcggcctcccaaagtgctgggattacaggtgtgagccatcacgcccggccaggggatgttt

SEQ ID NO: 4507 - DNA, 79 bp, Homo sapiens
ctagagtgcaatcgtgcaatctcggctcaccacaacctttgcctcccgggttcaagcaattctcctgccacagcctctc

SEQ ID NO: 4508 - DNA, 36 bp, Homo sapiens
cgcttcgatgccgcgcaggtgagccgggggctgaag

SEQ ID NO: 4509 - DNA, 25 bp, Homo sapiens
caatttgcctgcctcggccttccaa

SEQ ID NO: 4510 - DNA, 36 bp, Homo sapiens
ttgagcatccgtcagaagtccagcatgagtgcatcc

SEQ ID NO: 4511 - DNA, 500 bp, Homo sapiens
tggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggact

SEQ ID NO: 4512 - DNA, 195 bp, Homo sapiens
ttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggct

SEQ ID NO: 4513 - DNA, 500 bp, Homo sapiens
ggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccat

SEQ ID NO: 4514 - DNA, 36 bp, Homo sapiens
atcttcgtggatgatgagacgaagttgacgctgcat

SEQ ID NO: 4515 - DNA, 500 bp, Homo sapiens
ttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcg

SEQ ID NO: 4516 - DNA, 323 bp, Homo sapiens
ttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctg

SEQ ID NO: 4517 - DNA, 92 bp, Homo sapiens
ttatggcagagaacgatgtggacaatgagctcttggactatgaagatgatgaggtggagacagcagctgggggagatggggctgaggcccct

SEQ ID NO: 4518 - DNA, 36 bp, Homo sapiens
gccaagaaggatgtcaagggctcctatgtctccatc

SEQ ID NO: 4519 - DNA, 127 bp, Homo sapiens
cccctgccggcccagttatggcagagaacgatgtggacaatgagctcttggactatgaagatgatgaggtggagacagcagctgggggagatggggctgaggcccctgccaagaaggatgtcaaggg

SEQ ID NO: 4520 - DNA, 36 bp, Homo sapiens
ctcctatgtctccatccacagctctggctttcgtga

SEQ ID NO: 4521 - DNA, 36 bp, Homo sapiens
gatgtggacaatgagctcttggactatgaagatgat

SEQ ID NO: 4522 - DNA, 36 bp, Homo sapiens
gtctccatccacagctctggctttcgtgacttcctg

SEQ ID NO: 4523 - DNA, 92 bp, Homo sapiens
ctcaggccattctgggaatggatgtcctgtgccaggccaagtcgggcatgggaaagacagcagtgtttgtcttggccacactgcaacagctg

SEQ ID NO: 4524 - DNA, 451 bp, Homo sapiens
tatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggc

SEQ ID NO: 4525 - DNA, 500 bp, Homo sapiens
atcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaa

SEQ ID NO: 4526 - DNA, 500 bp, Homo sapiens
aggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagca

SEQ ID NO: 4527 - DNA, 500 bp, Homo sapiens
gatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagat

SEQ ID NO: 4528 - DNA, 96 bp, Homo sapiens
gatgatgagacgaagttgacgctgcatgggttgcagcagtactacgtgaaactgaaggacaacgagaagaaccggaagctctttgaccttctggat

SEQ ID NO: 4529 - DNA, 74 bp, Homo sapiens
tctgtgcagcggtgcattgccttggcccagctactagtggagcagaacttcccagccattgccatccaccgtgg

SEQ ID NO: 4530 - DNA, 109 bp, Homo sapiens
gtttaaagattttcaacgacgaattcttgtggctaccaacctatttggccgaggcatggacatcgagcgggtgaacattgcttttaattatgacatgcctgaggattct

SEQ ID NO: 4531 - DNA, 500 bp, Homo sapiens
ttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattct

SEQ ID NO: 4532 - DNA, 36 bp, Homo sapiens
cctggaagtcacatggagccccttcgacaaggatga

SEQ ID NO: 4533 - DNA, 36 bp, Homo sapiens
cgggaacaggctttctataacatgctgcgacggcag

SEQ ID NO: 4534 - DNA, 36 bp, Homo sapiens
gctgaagcggggcctgacggcctacttggaagtgca

SEQ ID NO: 4535 - DNA, 36 bp, Homo sapiens
gctgaagcggggcctgacgtgagcagctcctctgtt

SEQ ID NO: 4536 - DNA, 135 bp, Homo sapiens
cccgccggggcccccacggaagccccccgcgctctcccgagtgtccaggatgttttccgtggctcacccagccgccaaggtgccgcagcccgagcggctggacctggtgtacacggcgctgaagcggggcctgac

SEQ ID NO: 4537 - DNA, 94 bp, Homo sapiens
ccagccctcagctgcttcttctgtcaacaaggcctccacagtcaccaagcgcttctccacctatagccagagcccaccggacacaccctcactt

SEQ ID NO: 4538 - DNA, 36 bp, Homo sapiens
cggccgccccgccgcgaggtgagtccggcccgagga

SEQ ID NO: 4539 - DNA, 500 bp, Homo sapiens
acctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgggctgcgaggtactccgcgtcctacagctgagcgac

SEQ ID NO: 4540 - DNA, 407 bp, Homo sapiens
tttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgggctgcgaggtactccgcgt

SEQ ID NO: 4541 - DNA, 36 bp, Homo sapiens
cggccgccccgccgcgagacctagtcaccgacttgg

SEQ ID NO: 4542 - DNA, 241 bp, Homo sapiens
ggatagcaggaaggctgattgttggggagccagtattttctattatgaagcagagaactcttaaggagtggagtggatgatggaagaggtagatagtgctggaaggcgtgctaggtacaccgcaaagactccacagcaaatcctgcacacaaaatcgcgaatgctgcagccgagaccccacgcaagcaagcaccgcaggagacgtgggctgacagctgcgccccacgtgacctcccacccg

SEQ ID NO: 4543 - DNA, 500 bp, Homo sapiens
gacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcac

SEQ ID NO: 4544 - DNA, 36 bp, Homo sapiens
agccggcgctgagcccaggctgtggagttccacgag

SEQ ID NO: 4545 - DNA, 36 bp, Homo sapiens
taccatgtgccccgcaaggtgcagaaggtcagcctc

SEQ ID NO: 4546 - DNA, 36 bp, Homo sapiens
ctatccgacagtatccagtttcagctcaggctccaa

SEQ ID NO: 4547 - DNA, 36 bp, Homo sapiens
acaatcagtggacaacagggccatcccagtaacctg

SEQ ID NO: 4548 - DNA, 500 bp, Homo sapiens
gagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggat

SEQ ID NO: 4549 - DNA, 500 bp, Homo sapiens
aatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatgg

SEQ ID NO: 4550 - DNA, 66 bp, Homo sapiens
gttaccatggagagtagcatccctcaagcttcagccattcctgtggcaacaatcagtggacaacag

SEQ ID NO: 4551 - DNA, 500 bp, Homo sapiens
cacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatc

SEQ ID NO: 4552 - DNA, 55 bp, Homo sapiens
ggcacgccagtggctgcagccacagtagcacctattttggcaaccaacaccattc

SEQ ID NO: 4553 - DNA, 500 bp, Homo sapiens
tgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgacca

SEQ ID NO: 4554 - DNA, 500 bp, Homo sapiens
gttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagaccc

SEQ ID NO: 4555 - DNA, 500 bp, Homo sapiens
actctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggcc

SEQ ID NO: 4556 - DNA, 323 bp, Homo sapiens
aatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggata

SEQ ID NO: 4557 - DNA, 500 bp, Homo sapiens
ccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaac

SEQ ID NO: 4558 - DNA, 36 bp, Homo sapiens
cctgtgactctcctccagcatccccaaggagtcctc

SEQ ID NO: 4559 - DNA, 267 bp, Homo sapiens
cccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatc

SEQ ID NO: 4560 - DNA, 245 bp, Homo sapiens
gcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttaccta

SEQ ID NO: 4561 - DNA, 36 bp, Homo sapiens
tccggcctggccccggaggtgcaaagtaagaaaatt

SEQ ID NO: 4562 - DNA, 36 bp, Homo sapiens
tcccccacctctcaccagtggtcttctgtgtaaagt

SEQ ID NO: 4563 - DNA, 36 bp, Homo sapiens
tttaggtactgggcaaaggtaggcttgaggtcttta

SEQ ID NO: 4564 - DNA, 168 bp, Homo sapiens
actctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagaca

SEQ ID NO: 4565 - DNA, 500 bp, Homo sapiens
aattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttg

SEQ ID NO: 4566 - DNA, 186 bp, Homo sapiens
gcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtc

SEQ ID NO: 4567 - DNA, 78 bp, Homo sapiens
gcatctagaggcagcttatcatcgtatgcatatactcttatggtgctatattttctccagcagaggaatccaccagtc

SEQ ID NO: 4568 - DNA, 255 bp, Homo sapiens
ctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacg

SEQ ID NO: 4569 - DNA, 500 bp, Homo sapiens
acagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtg

SEQ ID NO: 4570 - DNA, 500 bp, Homo sapiens
ctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacg

SEQ ID NO: 4571 - DNA, 500 bp, Homo sapiens
ttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctagg

SEQ ID NO: 4572 - DNA, 500 bp, Homo sapiens
gatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaagga

SEQ ID NO: 4573 - DNA, 290 bp, Homo sapiens
tcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccac

SEQ ID NO: 4574 - DNA, 399 bp, Homo sapiens
ccccaggctggagtgcaatggtataatcttgtctcactgcaacctctgcctcctaggctcaagcgattctcctacctcagcctcccgagtagctgggattacatgcatgcgccaccgcgtccagctaatttttgtatttttagtagagacatagttgcccaggctggtcttgaactcctgaccttaggtgatccacctgcctcagcctcccaaagtgctgggattacaggcgtgagccactgtgcctggcttaatttttgtatttttagtggaggtggggtttcaccatgttagtcaggctggtctcgaactcctgagctcaggtgatccacccacctcagcctcccaaactgctggaattataggcgtgagccaccgcgcctgcccccagtttatgtt

SEQ ID NO: 4575 - DNA, 36 bp, Homo sapiens
ccagcctgggtgacagagcgagactccatttcaaaa

SEQ ID NO: 4576 - DNA, 36 bp, Homo sapiens
gagttccgatttgtccagtccaaactgggttatttg

SEQ ID NO: 4577 - DNA, 500 bp, Homo sapiens
tagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctgacatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaat

SEQ ID NO: 4578 - DNA, 36 bp, Homo sapiens
gtatatctggatcatcagattgtgcttcaagaagac

SEQ ID NO: 4579 - DNA, 500 bp, Homo sapiens
agtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgac

SEQ ID NO: 4580 - DNA, 500 bp, Homo sapiens
tcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttca

SEQ ID NO: 4581 - DNA, 410 bp, Homo sapiens
ccaggctggagtgcagtggcatgatctctgctcactacaacctctgcctcccgggttcaagcaattctgcctcaacctcccgagtagctgggactacaggtgcacgctgccatgcctggctaattttttgtattttagtagaaacggggtttcaccatgttgcccaggctggtcttgatctcctgaactcagacaatccacccacctcggcctcccaaagtgctaggattacaggcatgagccaccgtacctggccatatctttataatagagtaatttagattcctctgggtacataccctataatgggattgctgggtcaaatggtatttctgcctctaggtctttcaggaatctctcacctctcctactcaacatagtattgaaagttctggccagggcaatcaggc

SEQ ID NO: 4582 - DNA, 36 bp, Homo sapiens
tgcggtctttcaatatcggcttgtggaatatacccg

SEQ ID NO: 4583 - DNA, 233 bp, Homo sapiens
acagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccgg

SEQ ID NO: 4584 - DNA, 500 bp, Homo sapiens
actcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcct

SEQ ID NO: 4585 - DNA, 36 bp, Homo sapiens
gaagccaaccgtcccgaggcaccgccggtaagcagg

SEQ ID NO: 4586 - DNA, 160 bp, Homo sapiens
agaggcatggagaaggccgcccccgcggggcgctgatcccctcgccgcgcccgcgcgcacacgccccccgccgccgccgccgctgccgccgccgcgcgcccccagtacctcgctccccacccaggccccaccatgaccggctccgcggccgacactcacc

SEQ ID NO: 4587 - DNA, 47 bp, Homo sapiens
atgagttgagtggagatgcttctgtggaagatgatgcttttatcaag

SEQ ID NO: 4588 - DNA, 36 bp, Homo sapiens
cgatttcctcccctgaagtgctgccgggccaccact

SEQ ID NO: 4589 - DNA, 36 bp, Homo sapiens
ggtgacgagtctgacctgagttcggaatccagcatt

SEQ ID NO: 4590 - DNA, 36 bp, Homo sapiens
gccgccgccgatgccgagagacacctatggctgccg

SEQ ID NO: 4591 - DNA, 36 bp, Homo sapiens
gcatctacagcaaacttgtctcttcaggacagaaag

SEQ ID NO: 4592 - DNA, 36 bp, Homo sapiens
agaaccttgtaccctcatctgctcgtgtggataagc

SEQ ID NO: 4593 - DNA, 119 bp, Homo sapiens
ttcccgagattctagtgattctgctgatggacgggccacaccctctgagaaccttgtaccctcatctgctcgtgtggataagccccccagtgtgctgccctacttcaatcgtcctcctt

SEQ ID NO: 4594 - DNA, 380 bp, Homo sapiens
attcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccc

SEQ ID NO: 4595 - DNA, 500 bp, Homo sapiens
ctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactacca

SEQ ID NO: 4596 - DNA, 412 bp, Homo sapiens
gtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaatggcgacataaatcgcaaggtcctgggggacctgatctttaaccagcctgaccggcggcagctgctcatcgccatcacccaccccgagattcgcaaggagatgatgaaggagacgt

SEQ ID NO: 4597 - DNA, 36 bp, Homo sapiens
ccccatctcaccctgcaagtgagtaccatcccccca

SEQ ID NO: 4598 - DNA, 36 bp, Homo sapiens
tactgtctccaaaaccaggtgagtgagtgactgtgc

SEQ ID NO: 4599 - DNA, 36 bp, Homo sapiens
gagaaaatgagtatggaggatgaaaactttcggaag

SEQ ID NO: 4600 - DNA, 36 bp, Homo sapiens
aattttatctgattgcaggatgaaaactttcggaag

SEQ ID NO: 4601 - DNA, 500 bp, Homo sapiens
gcctggcagaagatcatgcagtttggaagttttcatgtactgatgaaagatactctacagaacttgtcaaatctttgaaacttggaatatattgctttcataatatgaagttttattgcctatctatctgaagtgtctaatttttcaagtttgtaagtttattatgtggttttaacattgggtgtttttgttttgtttttactatgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgcttttta

SEQ ID NO: 4602 - DNA, 36 bp, Homo sapiens
caccgggtggtggctggggtgagtgggggcgtctcc

SEQ ID NO: 4603 - DNA, 500 bp, Homo sapiens
gtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagc

SEQ ID NO: 4604 - DNA, 500 bp, Homo sapiens
agaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccacc

SEQ ID NO: 4605 - DNA, 323 bp, Homo sapiens
cttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagcc

SEQ ID NO: 4606 - DNA, 509 bp, Homo sapiens
gcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctctt

SEQ ID NO: 4607 - DNA, 500 bp, Homo sapiens
cggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcc

SEQ ID NO: 4608 - DNA, 273 bp, Homo sapiens
ccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactcca

SEQ ID NO: 4609 - DNA, 147 bp, Homo sapiens
ttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaa

SEQ ID NO: 4610 - DNA, 303 bp, Homo sapiens
aatctcggctcactgcaacctctgcctcccgggttcaagcgattctcgtgcctcagcctccagaatagctgggattacatgtgcatgccaccccatgcctggctaatttttgtatttttagtagagatggggtttcaccatgttggccaggctggtcttgaactgctgacctcaagtgataccccgcctcagcctctcaaagtgctgggattacaggcatgagccactgggcccggccaaactgagacatttttaagaagaaaggagacaacaggcataaatcagattgttaagattaggaat

SEQ ID NO: 4611 - DNA, 36 bp, Homo sapiens
ccagttcagcagccaggtctccatgtgtgcgaggtg

SEQ ID NO: 4612 - DNA, 143 bp, Homo sapiens
caagcaattcttctgcctcagctaatttttgtttttgagacagagtctctctccatcgcccaggctggagtgcagtggtgcgatctcagcttactgcaacctccgcctcctaggctcaagtgattttcctgcctcagtctccc

SEQ ID NO: 4613 - DNA, 500 bp, Homo sapiens
gccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggc

SEQ ID NO: 4614 - DNA, 36 bp, Homo sapiens
cagtcattgatggcagtcaaagcactgatgatgata

SEQ ID NO: 4615 - DNA, 500 bp, Homo sapiens
tagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccag

SEQ ID NO: 4616 - DNA, 211 bp, Homo sapiens
atttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagca

SEQ ID NO: 4617 - DNA, 82 bp, Homo sapiens
aggctggagtgcagtggcatgatctcagctcactgcagtctccacctcccagctgcaagcaattctcctgcctcagcctccc

SEQ ID NO: 4618 - DNA, 36 bp, Homo sapiens
gacagctgcttcagcctgcccaacatactaagatgg

SEQ ID NO: 4619 - DNA, 73 bp, Homo sapiens
gtttgattggttcttcgaagcggcctgccctgcctccctgcaggaggatccccccatcctgcggcagttccct

SEQ ID NO: 4620 - DNA, 500 bp, Homo sapiens
agcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgatagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctct

SEQ ID NO: 4621 - DNA, 335 bp, Homo sapiens
ttcccaccctggagtgcaatggcgcaatctcggctcaccacaacatctacttccccggttcaagcgattcttttgccttagtctcccaagtagctgggattaaaggcatgcaccaccatgcccagctaattttgtatttttagcagagacagggtttctctatgttaggctggtcttgaacttccgacctcaattgacccacccgccttggccttccaaagtgctggcattacaggctggagtgcaatggcgagatctcagctcactgcaactgctgtctcccgggttcaagcaattgtcctgcctcagcctcctgaatagctgggattacaggt

SEQ ID NO: 4622 - DNA, 56 bp, Homo sapiens
tgtccagactagtctcgaactcttgagctcaagcaatccacctgcctcaacctccc

SEQ ID NO: 4623 - DNA, 134 bp, Homo sapiens
agttcgagcttcccggctgctttgtttacctaagcaagcctgggcaatggcgggcgcccctcccccagcctcgttgccgccttgcagtttgatctcagactgctgtgctagcaatcagcgagattccgtgggcg

SEQ ID NO: 4624 - DNA, 36 bp, Homo sapiens
caccctgcaagctgccctgcctctcaccacctacct

SEQ ID NO: 4625 - DNA, 36 bp, Homo sapiens
ttttattccctttcagcaaattgcgatggaaaccta

SEQ ID NO: 4626 - DNA, 36 bp, Homo sapiens
tgatcctgttgagctcagcgtgctcttctgcaaatt

SEQ ID NO: 4627 - DNA, 36 bp, Homo sapiens
cgactaatagcattacagatgcccctgctaacagaa

SEQ ID NO: 4628 - DNA, 36 bp, Homo sapiens
tatggggttataacactgccacccaacttgacggag

SEQ ID NO: 4629 - DNA, 36 bp, Homo sapiens
cagaggaactccactgagctcgctcccccactgcct

SEQ ID NO: 4630 - DNA, 36 bp, Homo sapiens
ctccaagcagtgtttacagaccttagcagcatggac

SEQ ID NO: 4631 - DNA, 276 bp, Homo sapiens
aatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccaga

SEQ ID NO: 4632 - DNA, 157 bp, Homo sapiens
gaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggag

SEQ ID NO: 4633 - DNA, 256 bp, Homo sapiens
atcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgt

SEQ ID NO: 4634 - DNA, 393 bp, Homo sapiens
gatggaagaaaaagagcttcaagcatctaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcag

SEQ ID NO: 4635 - DNA, 500 bp, Homo sapiens
acaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagagggacagttactatgtttatacccagcaagagcttaaagagaagctgtatcaagaaatcatatcatatttcgacaaaggcaaaatgtgggagaaggccatcaa

SEQ ID NO: 4636 - DNA, 500 bp, Homo sapiens
ccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatc

SEQ ID NO: 4637 - DNA, 500 bp, Homo sapiens
tatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaa

SEQ ID NO: 4638 - DNA, 500 bp, Homo sapiens
ttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagt

SEQ ID NO: 4639 - DNA, 500 bp, Homo sapiens
ggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatatta

SEQ ID NO: 4640 - DNA, 100 bp, Homo sapiens
ggtggtgcgagatgacaatgggaacatcctagaccctgacgaaaccagcaccattgccctcttcaaggcccatgaggtggcctccaaaaggattgaggaa

SEQ ID NO: 4641 - DNA, 500 bp, Homo sapiens
agatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaa

SEQ ID NO: 4642 - DNA, 500 bp, Homo sapiens
agctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataac

SEQ ID NO: 4643 - DNA, 500 bp, Homo sapiens
tcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatca

SEQ ID NO: 4644 - DNA, 37 bp, Homo sapiens
tcatacatgggaaggtggatgatgaagaaaagcagca

SEQ ID NO: 4645 - DNA, 107 bp, Homo sapiens
catccgccagaggcagctcatcatgtcgcctttgataacatcacacgtgattggggagaatgagccactcacttcagtcttgaataaagtgattgcagcaaaggaag

SEQ ID NO: 4646 - DNA, 90 bp, Homo sapiens
agctcttgcccggtgacctcacccaggttcagaagaatttttcacacttggttgatagatcaacagcaatagcccggaagatgggctttc

SEQ ID NO: 4647 - DNA, 500 bp, Homo sapiens
tgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaag

SEQ ID NO: 4648 - DNA, 68 bp, Homo sapiens
gagcatttggggtggccttcgtgaagctgatgaacccggatggcaccactctgcaggatgggaggcac

SEQ ID NO: 4649 - DNA, 500 bp, Homo sapiens
agatttgcaccgagactgtgagaactacacagaagctgcctacacgcttctcttgcacgctgagcttctgcagtggtctgacaagccctgtgtgcctcatttgcttcagagggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctg

SEQ ID NO: 4650 - DNA, 46 bp, Homo sapiens
taaagccagtgatgagcttgccgcccagctacaaggataaacctgt

SEQ ID NO: 4651 - DNA, 500 bp, Homo sapiens
caaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgat

SEQ ID NO: 4652 - DNA, 103 bp, Homo sapiens
caaaggccaaagagtctccagttgatggataatcggctatcaccatttcacggttcttcacctcctcagtcaacacccttgagcccacctccactcactccca

SEQ ID NO: 4653 - DNA, 500 bp, Homo sapiens
aggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagca

SEQ ID NO: 4654 - DNA, 500 bp, Homo sapiens
cagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgc

SEQ ID NO: 4655 - DNA, 68 bp, Homo sapiens
cagatggaatcgcggccactcctgtcccacctccacctccccccaaaagcaagccctatgaaggcagc

SEQ ID NO: 4656 - DNA, 36 bp, Homo sapiens
agccttgctgctgttcaggcaagtttgtccagtgga

SEQ ID NO: 4657 - DNA, 36 bp, Homo sapiens
ggttttctgtctgtacagctgattttcacacccgct

SEQ ID NO: 4658 - DNA, 36 bp, Homo sapiens
cagtctgcagctactcaggttcagaatttaacatta

SEQ ID NO: 4659 - DNA, 36 bp, Homo sapiens
cagtctgcagctactcaggtgagcttgtctagcttc

SEQ ID NO: 4660 - DNA, 419 bp, Homo sapiens
cggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattc

SEQ ID NO: 4661 - DNA, 205 bp, Homo sapiens
ggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtccca

SEQ ID NO: 4662 - DNA, 63 bp, Homo sapiens
accactgtggctgctgtacagtctgacattcctgttgtctcgtcgtcatcgtcatcttcctgt

SEQ ID NO: 4663 - DNA, 500 bp, Homo sapiens
agtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtatttcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaggcttccagttctaccagcggcagtattacccaacagactatgttactagggagtacttcccctaccctaacggcaagccaagctcaaatg

SEQ ID NO: 4664 - DNA, 500 bp, Homo sapiens
cgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtc

SEQ ID NO: 4665 - DNA, 211 bp, Homo sapiens
cgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattc

SEQ ID NO: 4666 - DNA, 500 bp, Homo sapiens
ccaccaccatcaccacttcctcctctcgaatgcagcagccacagatctctgtctacagtggttcagaccgacatgctgtacaggtatttcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgt

SEQ ID NO: 4667 - DNA, 500 bp, Homo sapiens
agatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatgg

SEQ ID NO: 4668 - DNA, 500 bp, Homo sapiens
agctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggag

SEQ ID NO: 4669 - DNA, 68 bp, Homo sapiens
cttctcgagccagctctctctgtggggtgacaaatgaccactggcagcctatgctcacattgtccctg

SEQ ID NO: 4670 - DNA, 500 bp, Homo sapiens
tcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctg

SEQ ID NO: 4671 - DNA, 500 bp, Homo sapiens
ctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggat

SEQ ID NO: 4672 - DNA, 500 bp, Homo sapiens
ggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagct

SEQ ID NO: 4673 - DNA, 218 bp, Homo sapiens
tgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaa

SEQ ID NO: 4674 - DNA, 500 bp, Homo sapiens
ttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgg

SEQ ID NO: 4675 - DNA, 346 bp, Homo sapiens
tggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccc

SEQ ID NO: 4676 - DNA, 36 bp, Homo sapiens
tttctttaaacatctcaggtagcggaagtgaaattc

SEQ ID NO: 4677 - DNA, 274 bp, Homo sapiens
ccagtctggagtgcactggtgcgatctcagctcactggaacctctgcctcctgggttcaagcgattctctgcctcagcctcccaagtagctggaattacaggcatgcaccaccacacctggctaatttttgtatgtttagtagagatgggctttcaccatgttggtcaggctggtctcaaactcctgacctcaagtgatccacccaccttggcctcccaaagtgctgggattataggcatgagccactgtgcccagcctaccttttccttttta

SEQ ID NO: 4678 - DNA, 500 bp, Homo sapiens
gtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagttcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccct

SEQ ID NO: 4679 - DNA, 263 bp, Homo sapiens
gaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgta

SEQ ID NO: 4680 - DNA, 36 bp, Homo sapiens
tctggagtgccggcacaggtacaaagtgaaatcact

SEQ ID NO: 4681 - DNA, 133 bp, Homo sapiens
gcccagcctggagtgcagtggcttgatctcggatcacaacaatctccgcctcccgaattcaagcaattctcgtgcctttggccctcgctgaaagctgggaggctgggcacggtggctcatgcctgtaatccca

SEQ ID NO: 4682 - DNA, 36 bp, Homo sapiens
gcacttcgggaggccgaggcgggtgccacgtctatg

SEQ ID NO: 4683 - DNA, 249 bp, Homo sapiens
ggatcaagtatactgttaaaagaaaacaaaaacccaagcatgaggaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattt

SEQ ID NO: 4684 - DNA, 36 bp, Homo sapiens
tatttaatgggggtcgaggtctccttgaagaaaatg

SEQ ID NO: 4685 - DNA, 500 bp, Homo sapiens
acaaagttataattgaaaacactagagattcaaccttcgtttttatggaaggctctgaagatgcttatgttggatatatgacaataaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagta

SEQ ID NO: 4686 - DNA, 71 bp, Homo sapiens
ttagtggtcaaggagcatgtcccaccatcaagcactgtaacatcagtgactgtgaaaatgttggactatat

SEQ ID NO: 4687 - DNA, 102 bp, Homo sapiens
gaaatttccaataatgcgttagctgggatttgggttaaaaatcatggaaacccaattattagacggaatcatattcatcatggacgtgatgttggtgtgttc

SEQ ID NO: 4688 - DNA, 500 bp, Homo sapiens
tgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacagctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccac

SEQ ID NO: 4689 - DNA, 36 bp, Homo sapiens
ctttttttgtcactgcaggaagtactcccactaccc

SEQ ID NO: 4690 - DNA, 36 bp, Homo sapiens
attaaagagaccacagagtcgcttcatggagatata

SEQ ID NO: 4691 - DNA, 36 bp, Homo sapiens
ccagagcagcattcacagttttgacagtgacctgga

SEQ ID NO: 4692 - DNA, 36 bp, Homo sapiens
cggtagcagtaacctctgtgtgctggagccccaaag

SEQ ID NO: 4693 - DNA, 500 bp, Homo sapiens
gagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaa

SEQ ID NO: 4694 - DNA, 252 bp, Homo sapiens
caacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctctt

SEQ ID NO: 4695 - DNA, 234 bp, Homo sapiens
ctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccat

SEQ ID NO: 4696 - DNA, 500 bp, Homo sapiens
gagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtct

SEQ ID NO: 4697 - DNA, 500 bp, Homo sapiens
ttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggag

SEQ ID NO: 4698 - DNA, 140 bp, Homo sapiens
ccaagtggtgcctacctggttgcagggaacgcgcagatgagccacctccagagctacagtcttcccccggagcagctgtcttctctcagccaggcagtggtcccaccatccgcaaacccagcccttcctagtcagcagac

SEQ ID NO: 4699 - DNA, 36 bp, Homo sapiens
tttttttttaaccccaagacttgctacatttgtgat

SEQ ID NO: 4700 - DNA, 58 bp, Homo sapiens
ttgttagccaggatggtcttgatctcctgaccttgtgatccgcctgcctccacctccc

SEQ ID NO: 4701 - DNA, 500 bp, Homo sapiens
tgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagt

SEQ ID NO: 4702 - DNA, 126 bp, Homo sapiens
gtagctgtccctttcagcgaatggctccttggaagcaaacctgccagtggttatcaagctccttacatacccagcaccgacccccaggactggcttacccaaaagcagaccttggagaacagtcag

SEQ ID NO: 4703 - DNA, 500 bp, Homo sapiens
aatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcac

SEQ ID NO: 4704 - DNA, 36 bp, Homo sapiens
aaaggcagtggtcagcagccagtcagtctgcaggaa

SEQ ID NO: 4705 - DNA, 36 bp, Homo sapiens
ggttgggcgcggtggaagggtcttactggacagagc

SEQ ID NO: 4706 - DNA, 500 bp, Homo sapiens
ttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatga

SEQ ID NO: 4707 - DNA, 500 bp, Homo sapiens
agtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaa

SEQ ID NO: 4708 - DNA, 101 bp, Homo sapiens
accagcaacatcaacagcaactggcactcatgcagaaacagcagcttgcacaaattcagcaacagcaagcaaatagtaattcctccaccaacacatcacag

SEQ ID NO: 4709 - DNA, 500 bp, Homo sapiens
ggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaaca

SEQ ID NO: 4710 - DNA, 500 bp, Homo sapiens
acctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatgga

SEQ ID NO: 4711 - DNA, 55 bp, Homo sapiens
ggccaggctggtctggaactcctgacctcgtgatctgcccacctctgcctcccaa

SEQ ID NO: 4712 - DNA, 36 bp, Homo sapiens
gtctcctcgactcctgagctcgccgcgcatggccgg

SEQ ID NO: 4713 - DNA, 500 bp, Homo sapiens
acttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagc

SEQ ID NO: 4714 - DNA, 53 bp, Homo sapiens
agtccgagtggagagagcgagctgagtggttgtgtggtcgcgtctcggaaacc

SEQ ID NO: 4715 - DNA, 70 bp, Homo sapiens
gagcgagctgagtggttgtgtggtcgcgtctcggaaaccggtagcgcttgcagcatggctgaccaactga

SEQ ID NO: 4716 - DNA, 84 bp, Homo sapiens
agtccgagtggagagagcgagctgagtggttgtgtggtcgcgtctcggaaaccggtagcgcttgcagcatggctgaccaactga

SEQ ID NO: 4717 - DNA, 36 bp, Homo sapiens
ttcccgcccaggatcagggtccgaggcggtggagcg

SEQ ID NO: 4718 - DNA, 36 bp, Homo sapiens
tgttgcaggattgggaagggcacctgtgctggttgc

SEQ ID NO: 4719 - DNA, 229 bp, Homo sapiens
ttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaa

SEQ ID NO: 4720 - DNA, 170 bp, Homo sapiens
ggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgc

SEQ ID NO: 4721 - DNA, 246 bp, Homo sapiens
gctggagtccaatgctgcgatcttggatcactgcaacctctgcctgctgggtttaagcgattctcatgcctcagcctcctgagtagctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactg

SEQ ID NO: 4722 - DNA, 36 bp, Homo sapiens
cttccacagatgacttggcctccctcagtgaaaaaa

SEQ ID NO: 4723 - DNA, 36 bp, Homo sapiens
atgaggtggatgcagatgggaacgggaccattgact

SEQ ID NO: 4724 - DNA, 36 bp, Homo sapiens
ttccgtgtctttgacaaggatgggaatggctacatc

SEQ ID NO: 4725 - DNA, 26 bp, Homo sapiens
aggatatgatcaatgaggtggatgca

SEQ ID NO: 4726 - DNA, 455 bp, Homo sapiens
ccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcg

SEQ ID NO: 4727 - DNA, 36 bp, Homo sapiens
ggacacagacagtgaggaggagatccgagaggcgtt

SEQ ID NO: 4728 - DNA, 100 bp, Homo sapiens
agcgccgcagagctgcgtcacgtaatgacgaacctgggggagaagctgaccgatgaggaggtggatgagatgatcagggaggctgacatcgatggagatg

SEQ ID NO: 4729 - DNA, 36 bp, Homo sapiens
gggagacccagccaagagctgagggtaagggcaggt

SEQ ID NO: 4730 - DNA, 310 bp, Homo sapiens
acagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctag

SEQ ID NO: 4731 - DNA, 133 bp, Homo sapiens
ctgttctgaaaccatctgattggctttctgaggtttggctgggtggggactgctcatttggccactctgcaaattggacttgcccgcgttcctgaagcgctctcgagctgttctgtaaatacctggtgctaac

SEQ ID NO: 4732 - DNA, 500 bp, Homo sapiens
ccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccc

SEQ ID NO: 4733 - DNA, 272 bp, Homo sapiens
tggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctc

SEQ ID NO: 4734 - DNA, 91 bp, Homo sapiens
gggacaagtaagtcaatgtgggcagttcagtcgtctgggttttttccccttttctgttcatttcatctggctccccccaccacctccccac

SEQ ID NO: 4735 - DNA, 36 bp, Homo sapiens
gcatgatccgtgcccttgcttctgactttcgcctct

SEQ ID NO: 4736 - DNA, 275 bp, Homo sapiens
ttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggaga

SEQ ID NO: 4737 - DNA, 500 bp, Homo sapiens
aggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatggaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgacttttt

SEQ ID NO: 4738 - DNA, 36 bp, Homo sapiens
aagatcatgccactgcactccagtctgggtgtcaga

SEQ ID NO: 4739 - DNA, 36 bp, Homo sapiens
tctcccttgtccccaccgcctgaggagtctcccacg

SEQ ID NO: 4740 - DNA, 36 bp, Homo sapiens
tcaagcaagactacccagactggtcaagccgttgca

SEQ ID NO: 4741 - DNA, 36 bp, Homo sapiens
gacaaagccccctacctgcaaaaggccaaagataac

SEQ ID NO: 4742 - DNA, 36 bp, Homo sapiens
atcaacaaggtgcagaagcaggctgagagccagatc

SEQ ID NO: 4743 - DNA, 36 bp, Homo sapiens
tcagactgaggatgtcaggatggagagtgatgagga

SEQ ID NO: 4744 - DNA, 36 bp, Homo sapiens
ctcgggacagcatcccagtcttcccagataccaaac

SEQ ID NO: 4745 - DNA, 36 bp, Homo sapiens
tctgctgctgcagacaagaacctgaatggcgtgatg

SEQ ID NO: 4746 - DNA, 36 bp, Homo sapiens
gggaagctgagggtcctggtgggaaggaaaagggtc

SEQ ID NO: 4747 - DNA, 36 bp, Homo sapiens
gattatatcacctcccaggccccataccctgaacag

SEQ ID NO: 4748 - DNA, 36 bp, Homo sapiens
aaaatctacgaagagcagaatcgaggcatctacatg

SEQ ID NO: 4749 - DNA, 36 bp, Homo sapiens
taccccggtgtgtagcagattttcacccccagagcc

SEQ ID NO: 4750 - DNA, 500 bp, Homo sapiens
caccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacgagatcc

SEQ ID NO: 4751 - DNA, 110 bp, Homo sapiens
tggcgatacccccactgacgagcccgatgctctgtacgttgcatgccaagggcagccaaagggtgggcacgtgacctctatgcaacccaaggaaccagggcccctgcaat

SEQ ID NO: 4752 - DNA, 500 bp, Homo sapiens
actgccagcggttccttcctatccatgaaaacactgcagctgctatgcccagagcacagtgagggggctgcatatctggaggaggctcgctgtgcagtgtgtgaggggccaggggagctgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgcgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagca

SEQ ID NO: 4753 - DNA, 500 bp, Homo sapiens
catcacgcctgtcgccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacct

SEQ ID NO: 4754 - DNA, 500 bp, Homo sapiens
ctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaa

SEQ ID NO: 4755 - DNA, 500 bp, Homo sapiens
agtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaggagcaaactggagggcatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtcca

SEQ ID NO: 4756 - DNA, 84 bp, Homo sapiens
agtgcgaaattaaactggagggccccgtcagccctgatgtggagcctggcaaagaggagaccgaggaaagcaaaaaacgcaagc

SEQ ID NO: 4757 - DNA, 500 bp, Homo sapiens
tgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaggagcaaactggagggcatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggt

SEQ ID NO: 4758 - DNA, 500 bp, Homo sapiens
gccctacgtggtaaagcctgtggcgcctgttgcacctccagagctggtgcccatgaaggtgaaagagccagagccccagtactttcgcttcgaaggcgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggtggtgtggagcacatggagtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtgggg

SEQ ID NO: 4759 - DNA, 500 bp, Homo sapiens
atctgccctccagcagcccaatggactcctacccaggcctctgccagtccccgttcctggattctagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcgcctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccg

SEQ ID NO: 4760 - DNA, 500 bp, Homo sapiens
tagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcgcctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagcc

SEQ ID NO: 4761 - DNA, 500 bp, Homo sapiens
aacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagcgccttcgcaggacccctttggactggcccctgcctatcccctggagccccgcttccccacggcaccgcccacctatcccccctatcctagtcctacgggggcccctgcgcagccc

SEQ ID NO: 4762 - DNA, 25 bp, Homo sapiens
ataaccgggcagctcaccgcatcaa

SEQ ID NO: 4763 - DNA, 500 bp, Homo sapiens
aacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagcgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccgttcctcaaaccccgctgcccctc

SEQ ID NO: 4764 - DNA, 500 bp, Homo sapiens
ggtcccaacagcagctttccctgggtcttgcagttgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattggtcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcagaaccatgtg

SEQ ID NO: 4765 - DNA, 498 bp, Homo sapiens
gtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggacagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagacaagaacctgaatggcgtgatggtggcagtggcggagctgctgagcatgaagatccccaactcctatgaggtgctgttcccagagagccccgcccggggaggcactgagccaaagaagggggaagctgagggtcctg

SEQ ID NO: 4766 - DNA, 40 bp, Homo sapiens
gtctagacctgctggctgccttgcctacaccccctcacaa

SEQ ID NO: 4767 - DNA, 140 bp, Homo sapiens
tagcgattctcctgacagcattgtgccagcttcatcccctgagagcatcttgggggaggaggcccctcgtttccctcatctgggctcaggccggtgggagcaagaggaccgggccctctcccctgtcatccccctcattc

SEQ ID NO: 4768 - DNA, 500 bp, Homo sapiens
cttatggggcccttggcctggaggtccctggaaagctgcctgtcacaacttgggaaaagggcaaaggaagtgaggtgtcagtcatgctcacagtctctgctgctgcagacaagaacctgaatggcgtgatggtggcagtggcggagctgctgagcatgaagatccccaactcctatgaggtgctgttcccagagagccccgcccggggaggcactgagccaaagaagggggaagctgagggtcctggtgggaaggaaaagggtctggaaggcaagagcccagacactggccctgattggctgaagcagtttgatgcagtgttggctggctataccctgaagaggcaactagacatcttgagcctcctgaaacaggagagccccgccccagagccacccactcagcacaggtatacctacaatgtctccaatctggatgtgcgacagctctcggccccacctcctgaagaaccctccccgcccccttcccccttggcacct

SEQ ID NO: 4769 - DNA, 97 bp, Homo sapiens
gtggcagtggcggagctgctgagcatgaagatccccaactcctatgaggtgctgttcccagagagccccgcccggggaggcactgagccaaagaagg

SEQ ID NO: 4770 - DNA, 500 bp, Homo sapiens
caccctcgtcgctgccccccaccccacccccatcggtgcagcagaagatggtgaatggcgtcaccccatctgaagagctgggggagcaccccaaggatgctgcctctgcccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggacagcatcccagtcttcccagataccaaaccttatggggcccttggcctggaggtccctggaaagctgcctgtcacaacttgggaaaagggcaaaggaagtgaggtgtcagtcatgctcacagtc

SEQ ID NO: 4771 - DNA, 500 bp, Homo sapiens
catcccctgagagcatcttgggggaggaggcccctcgtttccctcatctgggctcaggccggtgggagcaagaggaccgggccctctcccctgtcatccccctcattcctcgggacagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagacaagaacctgaatggcgtgatggtggcagtggcggagctgctgagcatgaagatccccaactcctatgaggtgctgttcccagagagccccgcccggggaggcactgagccaaagaagggggaagctgagggtcctggtgggaaggaaaagggtctggaaggcaagagcccagacactggccctgattggctgaagcagtttgatgcagtgttggctggctataccctgaagaggcaactagacatc

SEQ ID NO: 4772 - DNA, 101 bp, Homo sapiens
ttgagcctgtggctgccatgagaaaagaggctgacatgctgcgactcttccctgagtatctgaagggcgaggagctctttgggctgacggtgcatgccgtg

SEQ ID NO: 4773 - DNA, 500 bp, Homo sapiens
tgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaa

SEQ ID NO: 4774 - DNA, 258 bp, Homo sapiens
ttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacgagatcccctgccactgtggagcctggaattgtcggaaatggatgaactaa

SEQ ID NO: 4775 - DNA, 36 bp, Homo sapiens
ctctcgagtcttcccaagtgccgatgaaataattat

SEQ ID NO: 4776 - DNA, 500 bp, Homo sapiens
ttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaa

SEQ ID NO: 4777 - DNA, 63 bp, Homo sapiens
tgtctttgcatggcacccccacaccaacaagtttgcagtggccctgctagatgactcagtccg

SEQ ID NO: 4778 - DNA, 305 bp, Homo sapiens
ctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattg

SEQ ID NO: 4779 - DNA, 116 bp, Homo sapiens
cggcatccggctgggccctggcactctgtcgatgggcctcttccctccatgggtccctgttcccccatctgtctctcaggagcgaagatctgatcgctgaatttgcccaagtcaca

SEQ ID NO: 4780 - DNA, 500 bp, Homo sapiens
cctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccc

SEQ ID NO: 4781 - DNA, 81 bp, Homo sapiens
aatctcggctctccgcaacctccacctcctggattcaagcgattctcctgcctccaagcgattctcctgcctcagcctcct

SEQ ID NO: 4782 - DNA, 36 bp, Homo sapiens
taaacaagcttccagccagaagcctgcctggaaaga

SEQ ID NO: 4783 - DNA, 177 bp, Homo sapiens
aatctcggctcattgcaacctccacctcccaggttcaagcaattctcctgcctcaggctcctgagtagttgggattacaggcacccaccaccacacccagctaatttttgtatttttagtagagacagggtttcaccatgttggccaggctggtctcgaactcctgacctcaggtga

SEQ ID NO: 4784 - DNA, 36 bp, Homo sapiens
tctccatcggggcagaagagattgtggacggcaacg

SEQ ID NO: 4785 - DNA, 500 bp, Homo sapiens
cggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgt

SEQ ID NO: 4786 - DNA, 25 bp, Homo sapiens
ctccagactcacttgccattgccag

SEQ ID NO: 4787 - DNA, 500 bp, Homo sapiens
ggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggac

SEQ ID NO: 4788 - DNA, 500 bp, Homo sapiens
ataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcac

SEQ ID NO: 4789 - DNA, 500 bp, Homo sapiens
gagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctgtctatccaccagctgattgagaatgcagatgcctgtttctgcattgacaatgaggccctctatgacatctgcttccgtaccctgaagctgacgacacccacctatggggatctcaaccaccta

SEQ ID NO: 4790 - DNA, 194 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctg

SEQ ID NO: 4791 - DNA, 36 bp, Homo sapiens
aggcaaaatgggaggaagaaacgactacagaaatga

SEQ ID NO: 4792 - DNA, 36 bp, Homo sapiens
gacccagaacagatgctgattcagaatctgataatt

SEQ ID NO: 4793 - DNA, 36 bp, Homo sapiens
agatctgggatgaagcagtgggttccagtcctacaa

SEQ ID NO: 4794 - DNA, 337 bp, Homo sapiens
tgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattgg

SEQ ID NO: 4795 - DNA, 36 bp, Homo sapiens
agatctgggatgaagcagcaaccagcaggccttttt

SEQ ID NO: 4796 - DNA, 89 bp, Homo sapiens
ccgcacatttagctctccaactaccatacaacgtgcttggtttaggtcggagcgcaaattttcttgaccatctctacgttggtattccc

SEQ ID NO: 4797 - DNA, 221 bp, Homo sapiens
ggactggggcggccacgcactccgccagaaggtcgccaggagcctccgcccttcaccttcctcggaaatccgccaggccacgcaagctccctgcccaacccttactgacgggggccacattttcccggcctccgcagccagaccttgacacaaaggacatcaaactgccgagggtaaaaaccccggaagggcggacacctccacatcgccttttgccacct

SEQ ID NO: 4798 - DNA, 36 bp, Homo sapiens
atgtcacagagcagccaggactgagtggacggttta

SEQ ID NO: 4799 - DNA, 152 bp, Homo sapiens
tggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccag

SEQ ID NO: 4800 - DNA, 36 bp, Homo sapiens
cccccgcgaacgcccaaggtgcacacatcttgacca

SEQ ID NO: 4801 - DNA, 94 bp, Homo sapiens
acttaaaactaataaagaggttccgggattagttcatcaacccagagcaaacatgcacatctctgaaagccaacaagaattcttcagaatgctg

SEQ ID NO: 4802 - DNA, 36 bp, Homo sapiens
gaagtggaggcattaaaggagaagctagagcatcaa

SEQ ID NO: 4803 - DNA, 500 bp, Homo sapiens
gtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggc

SEQ ID NO: 4804 - DNA, 36 bp, Homo sapiens
atatttccccattcactgccccgactatctgagatc

SEQ ID NO: 4805 - DNA, 36 bp, Homo sapiens
gggcgtgtgtcagcctgccctaggacttcatgtcta

SEQ ID NO: 4806 - DNA, 474 bp, Homo sapiens
tatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgccgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttctttt

SEQ ID NO: 4807 - DNA, 314 bp, Homo sapiens
tgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaag

SEQ ID NO: 4808 - DNA, 36 bp, Homo sapiens
gagaacagcaacatacaggtcctttctgaaagatct

SEQ ID NO: 4809 - DNA, 378 bp, Homo sapiens
gtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctct

SEQ ID NO: 4810 - DNA, 233 bp, Homo sapiens
gagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccac

SEQ ID NO: 4811 - DNA, 36 bp, Homo sapiens
cctcaagtaatctgcccacctcggcctcccaaagtg

SEQ ID NO: 4812 - DNA, 36 bp, Homo sapiens
ttgctctgtcgcccaggtcctcggcctcccaaagtg

SEQ ID NO: 4813 - DNA, 36 bp, Homo sapiens
cctcttgaagagtgacagtgctgtggagcatggttt

SEQ ID NO: 4814 - DNA, 36 bp, Homo sapiens
actgtaccctgcttccagtgctgtccccggcatagg

SEQ ID NO: 4815 - DNA, 243 bp, Homo sapiens
gttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcag

SEQ ID NO: 4816 - DNA, 36 bp, Homo sapiens
accagcaggcgtggtttggttttgctggcacacctg

SEQ ID NO: 4817 - DNA, 36 bp, Homo sapiens
gctagcaatgcgatgccggtcatctttggaaaatcc

SEQ ID NO: 4818 - DNA, 36 bp, Homo sapiens
actctcctgggatattcatggctgccaattctctta

SEQ ID NO: 4819 - DNA, 36 bp, Homo sapiens
atggtttgtgtattttagatcgccgatcgcaactgc

SEQ ID NO: 4820 - DNA, 36 bp, Homo sapiens
aggccagccagcaaaaaggtactgaagagagcaatg

SEQ ID NO: 4821 - DNA, 26 bp, Homo sapiens
gcaaggctctgtgggagctactgtaa

SEQ ID NO: 4822 - DNA, 42 bp, Homo sapiens
gatcgagcggaaaattccagaactgtacaagccaatattcag

SEQ ID NO: 4823 - DNA, 500 bp, Homo sapiens
cgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccact

SEQ ID NO: 4824 - DNA, 135 bp, Homo sapiens
tcctgctgagacggacttcgggggagactatggggggacccagtacagcctcgtggtgttcaacacagtggactgcgctcccgagtcctacgtacaatgtcacgctcccaccagcagcgcctatgagtttgtcac

SEQ ID NO: 4825 - DNA, 500 bp, Homo sapiens
cccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaac

SEQ ID NO: 4826 - DNA, 500 bp, Homo sapiens
agcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtgg

SEQ ID NO: 4827 - DNA, 89 bp, Homo sapiens
agcctcgtggtgttcaacacagtggactgcgctcccgagtcctacgtacaatgtcacgctcccaccagcagcgcctatgagtttgtcac

SEQ ID NO: 4828 - DNA, 340 bp, Homo sapiens
attccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcac

SEQ ID NO: 4829 - DNA, 156 bp, Homo sapiens
ccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctg

SEQ ID NO: 4830 - DNA, 500 bp, Homo sapiens
atgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctc

SEQ ID NO: 4831 - DNA, 500 bp, Homo sapiens
aattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaag

SEQ ID NO: 4832 - DNA, 500 bp, Homo sapiens
aggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttc

SEQ ID NO: 4833 - DNA, 36 bp, Homo sapiens
gtccccgggaggctagagatcatggaagggaagtgg

SEQ ID NO: 4834 - DNA, 36 bp, Homo sapiens
agctgtttgcctggagtgataatgtcactgcatccc

SEQ ID NO: 4835 - DNA, 36 bp, Homo sapiens
tctctttttttcctccagatagcacaacgatagaaa

SEQ ID NO: 4836 - DNA, 36 bp, Homo sapiens
acagctgaacgaatggcagaatggatacagcagaac

SEQ ID NO: 4837 - DNA, 500 bp, Homo sapiens
tgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacagg

SEQ ID NO: 4838 - DNA, 500 bp, Homo sapiens
tttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatc

SEQ ID NO: 4839 - DNA, 307 bp, Homo sapiens
tcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaatagga

SEQ ID NO: 4840 - DNA, 500 bp, Homo sapiens
gatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagtt

SEQ ID NO: 4841 - DNA, 60 bp, Homo sapiens
gatgatattgccagcagagctatagatctcctcaaagagatatacacgaaccttggtcca

SEQ ID NO: 4842 - DNA, 500 bp, Homo sapiens
attatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtcca

SEQ ID NO: 4843 - DNA, 500 bp, Homo sapiens
acacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccag

SEQ ID NO: 4844 - DNA, 114 bp, Homo sapiens
acacagataagttccaatatgccttcaagccctgatagctcttctgattcctccactggatctcctggaaaccatggtaatcattacagtgatggtcccaatccagaagtggaa

SEQ ID NO: 4845 - DNA, 500 bp, Homo sapiens
aattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgct

SEQ ID NO: 4846 - DNA, 95 bp, Homo sapiens
aattaagagctatttgtttagaccatgccaaacttggagaaagcagccttagtccatctcttgactcacttttctttggtccttcagcctcacaa

SEQ ID NO: 4847 - DNA, 500 bp, Homo sapiens
atgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaa

SEQ ID NO: 4848 - DNA, 243 bp, Homo sapiens
atgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggt

SEQ ID NO: 4849 - DNA, 500 bp, Homo sapiens
atcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaa

SEQ ID NO: 4850 - DNA, 500 bp, Homo sapiens
taatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtc

SEQ ID NO: 4851 - DNA, 36 bp, Homo sapiens
aagatccgcccacccgcggactggcagccacccttt

SEQ ID NO: 4852 - DNA, 36 bp, Homo sapiens
tgccaaccccaaccccaatgagcagtagcagtattt

SEQ ID NO: 4853 - DNA, 500 bp, Homo sapiens
accgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttg

SEQ ID NO: 4854 - DNA, 81 bp, Homo sapiens
agtgagctagccaactttgggcctcgcattaatgatatcaagaggatcattcagagccgagagagggaaatgaaagacttg

SEQ ID NO: 4855 - DNA, 36 bp, Homo sapiens
gcccagctggctggagatgacatggaggtcagcgcc

SEQ ID NO: 4856 - DNA, 36 bp, Homo sapiens
aacatcaaaaggtggcaggccatatacaaacagttc

SEQ ID NO: 4857 - DNA, 36 bp, Homo sapiens
ggctggacgccatgttccgtgccttcaaatctcttg

SEQ ID NO: 4858 - DNA, 253 bp, Homo sapiens
cgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgt

SEQ ID NO: 4859 - DNA, 126 bp, Homo sapiens
agcctcggtctctcccagggccgatcctgtctgcagtcacatctttgtggggcctgctgacccacaagcttttgttctctcagtacttgttacccagcttctcaacatccagggcccaatttgccc

SEQ ID NO: 4860 - DNA, 36 bp, Homo sapiens
tgcctggagttccccctggctctaggacactctaac

SEQ ID NO: 4861 - DNA, 108 bp, Homo sapiens
gatgaaagtgggaacatggattttgacaacttcatcagctgcttggtcaggctggacgccatgttccgtgccttcaaatctcttgacaaagatggcactggacaaatc

SEQ ID NO: 4862 - DNA, 25 bp, Homo sapiens
gacaaagatggcactggacaaatcc

SEQ ID NO: 4863 - DNA, 36 bp, Homo sapiens
tatcaacagcaacagcagaattacaagcggccaatg

SEQ ID NO: 4864 - DNA, 36 bp, Homo sapiens
ctctcttatacacagcagattcctccttatggacaa

SEQ ID NO: 4865 - DNA, 362 bp, Homo sapiens
cagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtc

SEQ ID NO: 4866 - DNA, 386 bp, Homo sapiens
aaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacagg

SEQ ID NO: 4867 - DNA, 177 bp, Homo sapiens
cagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggc

SEQ ID NO: 4868 - DNA, 500 bp, Homo sapiens
caaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaaggg

SEQ ID NO: 4869 - DNA, 500 bp, Homo sapiens
gcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggc

SEQ ID NO: 4870 - DNA, 500 bp, Homo sapiens
tatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggca

SEQ ID NO: 4871 - DNA, 500 bp, Homo sapiens
cagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaaga

SEQ ID NO: 4872 - DNA, 499 bp, Homo sapiens
ctggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaattttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttggga

SEQ ID NO: 4873 - DNA, 500 bp, Homo sapiens
tttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcaga

SEQ ID NO: 4874 - DNA, 116 bp, Homo sapiens
gactgcctgaaaagcgccaacactgagccctactaccggaggcaggcgtgggaagtgatcaaatgcttcctggtggccatgatgagcctggaggacaacaagcacgcactctacca

SEQ ID NO: 4875 - DNA, 38 bp, Homo sapiens
ttgtcgccagaaggaagatggcggatctggaggagcag

SEQ ID NO: 4876 - DNA, 25 bp, Homo sapiens
tctggaggagcagttgtctgatgaa

SEQ ID NO: 4877 - DNA, 36 bp, Homo sapiens
ccattttggtttactcaggattcactccttctccag

SEQ ID NO: 4878 - DNA, 36 bp, Homo sapiens
ataaaagtggattgcaaggatatgacatgtctacat

SEQ ID NO: 4879 - DNA, 36 bp, Homo sapiens
ttcctcaaagttgcagaggtaaactgtctttaagtg

SEQ ID NO: 4880 - DNA, 36 bp, Homo sapiens
ataccagacctttcacaggcccctagcagtcttctt

SEQ ID NO: 4881 - DNA, 420 bp, Homo sapiens
ctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttg

SEQ ID NO: 4882 - DNA, 88 bp, Homo sapiens
tgcagtgtcttccctggcaagcactggtctatctctgaccaaagtggatgaaagggaaaagcaggcagcattagaggaagaacaggca

SEQ ID NO: 4883 - DNA, 500 bp, Homo sapiens
caagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacctggcccttcgcctgtgacatctgcggcaaaaccttcggccacgctgtgagc

SEQ ID NO: 4884 - DNA, 500 bp, Homo sapiens
cccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacctggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttc

SEQ ID NO: 4885 - DNA, 469 bp, Homo sapiens
ggccttttgccatgtctgggcgtggcaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctactgcccaagaagaccgagagccaccacaaggcgaagggcaagtagaagcctggattagtttgcagcaactcaatcccaaaggaaccaaaggctcttttcagagccaccta

SEQ ID NO: 4886 - DNA, 470 bp, Homo sapiens
gttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataatgtctccatagaatcactttccaatacaacggctcttttcagagccaccta

SEQ ID NO: 4887 - DNA, 120 bp, Homo sapiens
agttcccggtgggccgagtgcaccgcctgctccgtaaaggcaactacgcagagcgggttggggcaggcgcgccggtgtacctggcggcggtgttagagtacctgaccgccgagatcctgg

SEQ ID NO: 4888 - DNA, 36 bp, Homo sapiens
ccaaagcgaaatcccgctcttctcgcgctggtctcc

SEQ ID NO: 4889 - DNA, 172 bp, Homo sapiens
ctcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacag

SEQ ID NO: 4890 - DNA, 172 bp, Homo sapiens
ctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaa

SEQ ID NO: 4891 - DNA, 36 bp, Homo sapiens
gggcaagtgatttgacaggtatctgagctcccggaa

SEQ ID NO: 4892 - DNA, 500 bp, Homo sapiens
attttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggct

SEQ ID NO: 4893 - DNA, 500 bp, Homo sapiens
ttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagctt

SEQ ID NO: 4894 - DNA, 331 bp, Homo sapiens
ttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctga

SEQ ID NO: 4895 - DNA, 36 bp, Homo sapiens
agagaaaagccatggccgacaaggtcctgaaggaga

SEQ ID NO: 4896 - DNA, 36 bp, Homo sapiens
agagaaaagccatggccgacaagggtgctgaacaag

SEQ ID NO: 4897 - DNA, 36 bp, Homo sapiens
gtcaccggctcccgcgaaatcaagtcccagcagagc

SEQ ID NO: 4898 - DNA, 264 bp, Homo sapiens
tctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaac

SEQ ID NO: 4899 - DNA, 132 bp, Homo sapiens
gaggtgacccgaatcctggatgggaagcgcatccaataccagctagtggacatctcccaggacaacgccctgagggatgagatgcgagccttggcaggcaaccccaaggccaccccaccccagattgtcaac

SEQ ID NO: 4900 - DNA, 53 bp, Homo sapiens
gggctggtcttgaactcctgaactcaagcagtccttccacctcggcctcccaa

SEQ ID NO: 4901 - DNA, 36 bp, Homo sapiens
aataatttatatctgaagacggagagcctgtaatat

SEQ ID NO: 4902 - DNA, 36 bp, Homo sapiens
tgtgtggttttattttagaaaagccagtgaaggttt

SEQ ID NO: 4903 - DNA, 407 bp, Homo sapiens
ttatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttcca

SEQ ID NO: 4904 - DNA, 205 bp, Homo sapiens
tatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaa

SEQ ID NO: 4905 - DNA, 102 bp, Homo sapiens
ccacagtcacatcttcctttgactgtcagcttcctctgcatttcaggactcttgcaatcacattgagcccacccaaattctccagggtcatctccctatttc

SEQ ID NO: 4906 - DNA, 500 bp, Homo sapiens
tttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtc

SEQ ID NO: 4907 - DNA, 25 bp, Homo sapiens
gagcccacccaaattctccagggtc

SEQ ID NO: 4908 - DNA, 36 bp, Homo sapiens
ttgtgctcaaccctacagcctacccgttccatcccg

SEQ ID NO: 4909 - DNA, 58 bp, Homo sapiens
gtgttagccaggatggtctcgatctcctgacctcgtgatccgcctgccttggcctccc

SEQ ID NO: 4910 - DNA, 183 bp, Homo sapiens
ttcgcagctggagagagccctcctcaggggctgtctctgccttcccttcttcccatgtgtatctggggcagctgaggcagggctaggagaagagcccaggttcctcctgccacctccaagcgatgaagcagccctgggccaactccagcattctcgtgtgaactgcagaggagccctgcgctt

SEQ ID NO: 4911 - DNA, 36 bp, Homo sapiens
tgtactcgacaccttgcgatccaaaatacggagctg

SEQ ID NO: 4912 - DNA, 36 bp, Homo sapiens
ggtttgcaggttctaaaggtggagaagatagacaat

SEQ ID NO: 4913 - DNA, 500 bp, Homo sapiens
aaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtc

SEQ ID NO: 4914 - DNA, 403 bp, Homo sapiens
cggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcgg

SEQ ID NO: 4915 - DNA, 116 bp, Homo sapiens
acagccgtgcacgcgggagtcatcagcaacgagagtgggggtgacgtggacgtgatgcccgtggataaaaagaagacctacgtgggctcgctcaggaatggagttcagtctgaaag

SEQ ID NO: 4916 - DNA, 36 bp, Homo sapiens
cacaggaaaatctgccctagacaatggacctcagat

SEQ ID NO: 4917 - DNA, 87 bp, Homo sapiens
tgcccaggctggagtgcaatagtgcgatctcggctcactgcaacctctgcctcccgggtttaagtgattctcctatctcagcctccc

SEQ ID NO: 4918 - DNA, 500 bp, Homo sapiens
acatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaag

SEQ ID NO: 4919 - DNA, 500 bp, Homo sapiens
gtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttcccc

SEQ ID NO: 4920 - DNA, 36 bp, Homo sapiens
ctttctccgtcaccccaggtcctgccgccaccccca

SEQ ID NO: 4921 - DNA, 62 bp, Homo sapiens
aatctcagctcacagcaacctctgcctcctgggctgaaaccattatcatgcctcaggctcca

SEQ ID NO: 4922 - DNA, 418 bp, Homo sapiens
cttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggattaaaata

SEQ ID NO: 4923 - DNA, 36 bp, Homo sapiens
cgtgcgcctgtagtcccagctactcgggaggctgag

SEQ ID NO: 4924 - DNA, 36 bp, Homo sapiens
cctgtaccttgtcctcagcatctggaatcaagagac

SEQ ID NO: 4925 - DNA, 36 bp, Homo sapiens
cttccaggatactacatgaacctcaaccagaaccct

SEQ ID NO: 4926 - DNA, 153 bp, Homo sapiens
cggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcc

SEQ ID NO: 4927 - DNA, 500 bp, Homo sapiens
aaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggt

SEQ ID NO: 4928 - DNA, 500 bp, Homo sapiens
ccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgc

SEQ ID NO: 4929 - DNA, 264 bp, Homo sapiens
cggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagacc

SEQ ID NO: 4930 - DNA, 36 bp, Homo sapiens
gcactttgggaggccgagggtcaggccaacaaggtg

SEQ ID NO: 4931 - DNA, 152 bp, Homo sapiens
gtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccat

SEQ ID NO: 4932 - DNA, 36 bp, Homo sapiens
gcaacctccacctcccaggttcaagcaatactcctg

SEQ ID NO: 4933 - DNA, 36 bp, Homo sapiens
cagccccctcctgcccagctctgtgatccaggagct

SEQ ID NO: 4934 - DNA, 500 bp, Homo sapiens
tcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttac

SEQ ID NO: 4935 - DNA, 434 bp, Homo sapiens
tcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccc

SEQ ID NO: 4936 - DNA, 36 bp, Homo sapiens
gggctgctgcactggaagcatgtttggatgtaacca

SEQ ID NO: 4937 - DNA, 287 bp, Homo sapiens
aggatggagtgcaatttgtgcagtcacaactcatggcagcctcaacctcccaggccgaagcacgcctctcacctcagcctcccaagtagctgggaccacaggcacacaccaccatgcctggctaattttttaatttattttttgtagagacagagtctcactgcgttgcctaggctgctcttgaactcctgggctcaagtgatccacctgctttggcctcccaaagtgttgggcttataggtgtgagccactgcacctggctgtgaacttagtatgtgtatatatgt

SEQ ID NO: 4938 - DNA, 500 bp, Homo sapiens
ctgcctctcccagatgcacagctgggctccgctgaaggtgctgcacaatgactccgacatcctcttccctgtcagtggcgtgggctcctacagcccagcagatgcccccctcggaagcctggagaacgggacaggaccagaggaccacgttctcccagatcctggacttcggtacagtgtggaagccagctctccaggccacggaagtcctctgagcagcctgttaccttctgcctcagtgccagagtccatgacaattagtgaactgcgccaggccactgtggccatgatgaacaggaaggatgagctggaggaggagaacagatcactgcgaaacctgctcgacggtgagatggagcactcagccgcgctccggcaagaggtggacaccttgaaaaggaaggtggctgaacaggaggagcggcagggcatgaaggtccaggcgctggccagagagaacgaggtgctcaaagtccaactgaagaaatatgtaggagctg

SEQ ID NO: 4939 - DNA, 36 bp, Homo sapiens
aaacatttggaccagcaggagttcggagccctacag

SEQ ID NO: 4940 - DNA, 37 bp, Homo sapiens
ggaagtacaccacaatccagctgtcctggggaagggt

SEQ ID NO: 4941 - DNA, 210 bp, Homo sapiens
agccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactc

SEQ ID NO: 4942 - DNA, 222 bp, Homo sapiens
ctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgatt

SEQ ID NO: 4943 - DNA, 36 bp, Homo sapiens
gataaattctggtgccaggtgatctttgacgagact

SEQ ID NO: 4944 - DNA, 26 bp, Homo sapiens
agaccatgtgtgtctgatctgctggg

SEQ ID NO: 4945 - DNA, 70 bp, Homo sapiens
ccggaagtgcgggcgctcagggagctgtcaccgtggtcggcggcggcggcggcggcggcggcacagagcc

SEQ ID NO: 4946 - DNA, 500 bp, Homo sapiens
gaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctac

SEQ ID NO: 4947 - DNA, 26 bp, Homo sapiens
gccactgcagccaggcgagagcctgc

SEQ ID NO: 4948 - DNA, 123 bp, Homo sapiens
gaccggtattttgtgttatacaaaccgccccctaaagacaacattcccgccctagtggaggagtacctggaacgcgccaccttcgtagccaatgacctcgactggctcctggccttgcctcac

SEQ ID NO: 4949 - DNA, 100 bp, Homo sapiens
agaccatgtgtgtctgatctgctgggatcctagagctggaacaggccaagtgatattgtgaaaagaacactggacagcaagacaggagaccttggatctg

SEQ ID NO: 4950 - DNA, 36 bp, Homo sapiens
ggtggtggagccgccgaggtgatctttgacgagact

SEQ ID NO: 4951 - DNA, 46 bp, Homo sapiens
aggccacctcgtgtatgcagagaccatgtgtgtctgatctgctggg

SEQ ID NO: 4952 - DNA, 312 bp, Homo sapiens
caccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtcc

SEQ ID NO: 4953 - DNA, 500 bp, Homo sapiens
actccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccac

SEQ ID NO: 4954 - DNA, 36 bp, Homo sapiens
acaacattcccgccctagtggaggagtacctggaac

SEQ ID NO: 4955 - DNA, 73 bp, Homo sapiens
agaccatgtgtgtctgatctgctgggatcctagagctggaacaggtgtcaaggactaggcagactggtcctct

SEQ ID NO: 4956 - DNA, 56 bp, Homo sapiens
gccaagtgatattgtgaaaagaacactggacagcaagacaggagaccttggatctg

SEQ ID NO: 4957 - DNA, 32 bp, Homo sapiens
agccaagttactacagtgacctggatgaaacc

SEQ ID NO: 4958 - DNA, 500 bp, Homo sapiens
tttctaatatcagaaaccaaatggaaacccttcattctcagccacatcaagaagaaaatttgtgttttgaaaattccttttctcttataaaccttttgcctattaatgctgtagagcctacttcttcacagcaaatacccaacagagaaacatctgaagccaataaagagagaagaaaaatgacatcaaagtcaagtgaatcaaatatatattcacctttaacctcttttatcactgctgattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgcc

SEQ ID NO: 4959 - DNA, 36 bp, Homo sapiens
gagcgagcgggagcggaggctgctgcggaggcgaag

SEQ ID NO: 4960 - DNA, 36 bp, Homo sapiens
cggcctccggaagtgctgggattacaggcgtgagcc

SEQ ID NO: 4961 - DNA, 36 bp, Homo sapiens
cccagattcaaatcctgactcggcctcccagagtgc

SEQ ID NO: 4962 - DNA, 36 bp, Homo sapiens
ctgactcaaatgatccccctgcctcggcctcccaga

SEQ ID NO: 4963 - DNA, 41 bp, Homo sapiens
ctgcccgggccagacgtttaggaggagccgctgcatccgag

SEQ ID NO: 4964 - DNA, 36 bp, Homo sapiens
ttatatggacagtttagggtggtctcatggattata

SEQ ID NO: 4965 - DNA, 36 bp, Homo sapiens
cctgagcataagaactgggattgcaggcgtgagcca

SEQ ID NO: 4966 - DNA, 41 bp, Homo sapiens
tggaattataggcgtgagccactgcgcacggcctggggagg

SEQ ID NO: 4967 - DNA, 479 bp, Homo sapiens
accaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaaga

SEQ ID NO: 4968 - DNA, 36 bp, Homo sapiens
  misc_feature (32)..(36): n is a, c, g, or t
agcccttaaataaagcagccagcgcacatccnnnnn

SEQ ID NO: 4969 - DNA, 500 bp, Homo sapiens
gtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagc

SEQ ID NO: 4970 - DNA, 36 bp, Homo sapiens
catccagaatgacctcaccaagctctccaagtacca

SEQ ID NO: 4971 - DNA, 36 bp, Homo sapiens
cttcaaaaagaaaaggacaggctgagaacagaaagg

SEQ ID NO: 4972 - DNA, 500 bp, Homo sapiens
tgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctg

SEQ ID NO: 4973 - DNA, 85 bp, Homo sapiens
ggctggagtgcagtggcatgatccctgctcattgcaacctccgcctccctgattcaaaggatttttccacctcagcttctcatgt

SEQ ID NO: 4974 - DNA, 36 bp, Homo sapiens
ctgtcaagcctcctacaggcaccttctcactactag

SEQ ID NO: 4975 - DNA, 216 bp, Homo sapiens
tctgaacccaggcaagaagttcccatgtgttcagaccctgaacccaggcaagaagttcccacatgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagac

SEQ ID NO: 4976 - DNA, 36 bp, Homo sapiens
tctgaacccaggcaagaagttcccatgtatacaggc

SEQ ID NO: 4977 - DNA, 36 bp, Homo sapiens
cctgaatccaggcgagaagttcccatgtatacaggc

SEQ ID NO: 4978 - DNA, 500 bp, Homo sapiens
tctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcat

SEQ ID NO: 4979 - DNA, 500 bp, Homo sapiens
accctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttca

SEQ ID NO: 4980 - DNA, 500 bp, Homo sapiens
cctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaag

SEQ ID NO: 4981 - DNA, 36 bp, Homo sapiens
gtgatttgcccatctcggcttcccaaagtgctgaga

SEQ ID NO: 4982 - DNA, 36 bp, Homo sapiens
tgatccacacgcctcagactcccaaagtgctgggat

SEQ ID NO: 4983 - DNA, 36 bp, Homo sapiens
cagcaattctgcagaaagggctcgaccacttactgg

SEQ ID NO: 4984 - DNA, 500 bp, Homo sapiens
ccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttc

SEQ ID NO: 4985 - DNA, 63 bp, Homo sapiens
gatcacggttcactgcagcattgacctccctaggctcaggtgttgctcccacctcagtcttct

SEQ ID NO: 4986 - DNA, 36 bp, Homo sapiens
caaactcctgacctcaagtgatccgcccatctcctc

SEQ ID NO: 4987 - DNA, 36 bp, Homo sapiens
aagtagctaggactacaggtgcgttccaccacacct

SEQ ID NO: 4988 - DNA, 36 bp, Homo sapiens
gacgacgcccccggccagtccctgtacgagcggtta

SEQ ID NO: 4989 - DNA, 36 bp, Homo sapiens
atgttccctcacctgaagaaaaaagcagtcatcgat

SEQ ID NO: 4990 - DNA, 36 bp, Homo sapiens
ttgcagatgtgggcaaacattctgaagcgtgttccc

SEQ ID NO: 4991 - DNA, 36 bp, Homo sapiens
ccatggtgactatgccaggagagactcttgcttctc

SEQ ID NO: 4992 - DNA, 36 bp, Homo sapiens
attcatcactttgaaaaggctgtcacccttgaccca

SEQ ID NO: 4993 - DNA, 36 bp, Homo sapiens
ggcacgcatttttgacaggttgctgaagcagaagat

SEQ ID NO: 4994 - DNA, 236 bp, Homo sapiens
ggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggca

SEQ ID NO: 4995 - DNA, 36 bp, Homo sapiens
tcattaacccctcctaaggcatgttatttgaaagca

SEQ ID NO: 4996 - DNA, 179 bp, Homo sapiens
attgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacag

SEQ ID NO: 4997 - DNA, 102 bp, Homo sapiens
gccgctcaagccctccagagcattgctacggctgctgcccttgtactactacctccaaatacgttcttgctggtagtggcggcagcaggaccaattacctct

SEQ ID NO: 4998 - DNA, 36 bp, Homo sapiens
tttttgctctccctcgagaagctccagatggcgtct

SEQ ID NO: 4999 - DNA, 50 bp, Homo sapiens
gctgctgcccttgtactactacctccaaatacgttcttgctggtagtggc

SEQ ID NO: 5000 - DNA, 47 bp, Homo sapiens
cgagaagctccagatggcgtcttccgtgggcaacgtggccgacagca

SEQ ID NO: 5001 - DNA, 187 bp, Homo sapiens
aattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggca

SEQ ID NO: 5002 - DNA, 235 bp, Homo sapiens
aacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttg

SEQ ID NO: 5003 - DNA, 129 bp, Homo sapiens
caaagtctggaagcaaagaatatctagccctctgttcaacaccaaacaatacacaatggaactagagcggctctatctacagatgtgggagcattatgcagctggcaacaaacctgaccacatgattaa

SEQ ID NO: 5004 - DNA, 500 bp, Homo sapiens
agtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggca

SEQ ID NO: 5005 - DNA, 500 bp, Homo sapiens
ctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggc

SEQ ID NO: 5006 - DNA, 500 bp, Homo sapiens
gcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgat

SEQ ID NO: 5007 - DNA, 500 bp, Homo sapiens
ggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaa

SEQ ID NO: 5008 - DNA, 500 bp, Homo sapiens
actggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaac

SEQ ID NO: 5009 - DNA, 500 bp, Homo sapiens
atggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaat

SEQ ID NO: 5010 - DNA, 500 bp, Homo sapiens
gagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaatt

SEQ ID NO: 5011 - DNA, 46 bp, Homo sapiens
gcgagtgtttagagacttcgggtccctgactcgcctccagcagtgg

SEQ ID NO: 5012 - DNA, 36 bp, Homo sapiens
ctgttactcctggtgttgccacccacctgggccaga

SEQ ID NO: 5013 - DNA, 36 bp, Homo sapiens
aaaactctgcttctgttggtattatccaaagagatg

SEQ ID NO: 5014 - DNA, 500 bp, Homo sapiens
tgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgt

SEQ ID NO: 5015 - DNA, 83 bp, Homo sapiens
ttgtccaggctggtctgcagctcctggcctcaagtgatcctccttcttcagcttcccaaagtgctaggattacaggcgtgaac

SEQ ID NO: 5016 - DNA, 82 bp, Homo sapiens
ttggccaggctggtcttgaactcctgacttcatgtgatcgcctgcctcggcctcccaaagtgctgggattacaggcgtgaac

SEQ ID NO: 5017 - DNA, 116 bp, Homo sapiens
actctaggagataacattactgtgaaaatgtattctccatcgtggcctaactttgattatactatggtggttatttttgtaattgcggtgttcactgtggcattaggtggatactg

SEQ ID NO: 5018 - DNA, 500 bp, Homo sapiens
acaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagt

SEQ ID NO: 5019 - DNA, 59 bp, Homo sapiens
ttgtccaggctggtctcgaactcctgagcttaagcgattcgcccaccttggcctcccaa

SEQ ID NO: 5020 - DNA, 99 bp, Homo sapiens
agctaatttttgtatttttagtagagacagggtttcaccatgttggccaggctggtcccgaactcctgacctcaggtgatccacccacctcggcctccc

SEQ ID NO: 5021 - DNA, 140 bp, Homo sapiens
cgttctatcacccgttcctactacaggggagcagctggagcactgctggtgtacgacattacaaggcgtgaaaccttcaaccacctgacctcatggttagaggatgcccggcagcactctagttccaacatggttatcat

SEQ ID NO: 5022 - DNA, 122 bp, Homo sapiens
gtgtggggaagtcatgtctcctcctgcagtttacagataagcggttccagcctgtccacgacctcacaataggtgtggagtttggagctcgtatggtcaacattgatggaaaacaaatcaaa

SEQ ID NO: 5023 - DNA, 500 bp, Homo sapiens
gtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaac

SEQ ID NO: 5024 - DNA, 190 bp, Homo sapiens
gaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctg

SEQ ID NO: 5025 - DNA, 76 bp, Homo sapiens
ggatgtgaagagagaagaaggagaggcctttgctagggagcatggacttatattcatggaaacttcagccaaaaca

SEQ ID NO: 5026 - DNA, 225 bp, Homo sapiens
aatcttggctcactgcaacctccacccctccgggttcaagcgattctcctgccacagcctcccaaatagctgggattataggcacatgccaccatgcccagctaatttttgtatttttagtagagatgggttttcgccatgttggccaagctggtcttgaacctctgatctcagatgatccacccgcctcagcctcccaaagtgctgggattacagacgcgagcc

SEQ ID NO: 5027 - DNA, 36 bp, Homo sapiens
gatgaccctacagaacagcctcggcctccgccccgg

SEQ ID NO: 5028 - DNA, 230 bp, Homo sapiens
gatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctggga

SEQ ID NO: 5029 - DNA, 154 bp, Homo sapiens
atggggaagagtctgattaagattcacaccagagtccgggtccagctccggctgactaatcactgctttcggcccctaagtgtgcgcatcctgaggatggggccccggctccagggtagggtcctgactgctgtgacccccgggcaagggaatc

SEQ ID NO: 5030 - DNA, 36 bp, Homo sapiens
aggcgctgtcccagactgtccccagcagtggcacca

SEQ ID NO: 5031 - DNA, 378 bp, Homo sapiens
agtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgag

SEQ ID NO: 5032 - DNA, 500 bp, Homo sapiens
tccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagt

SEQ ID NO: 5033 - DNA, 36 bp, Homo sapiens
aaagctctggatgaaaaggtgagagagcgattacga

SEQ ID NO: 5034 - DNA, 500 bp, Homo sapiens
ttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacagactgaagataaaaaccgccagttacaggagcgcttggaattggcagagcaaaagctgcaacagacactgaggaaggcagagacgctcccggaggtggaggcggagctggcccagagggtggcagcgctttccaaggctgaagagagaca

SEQ ID NO: 5035 - DNA, 36 bp, Homo sapiens
aggccccatcctgcccagaggattgctgctgcctcc

SEQ ID NO: 5036 - DNA, 500 bp, Homo sapiens
tctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctgg

SEQ ID NO: 5037 - DNA, 210 bp, Homo sapiens
gattcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtataccca

SEQ ID NO: 5038 - DNA, 36 bp, Homo sapiens
cgtggccctccccggaatgctggtgagattggagag

SEQ ID NO: 5039 - DNA, 343 bp, Homo sapiens
ctctttagccgccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgc

SEQ ID NO: 5040 - DNA, 420 bp, Homo sapiens
gaccattcagaaataaagcaaaaagcaggccacaaccttaaccaacaccaaagaaacatccaagcaataaagtggaagactaaccaagatttggacattggaatgtttactgttattctttaagaaacatctacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaa

SEQ ID NO: 5041 - DNA, 105 bp, Homo sapiens
ggtgcagaagctgccaatgtgactggcccggatggagttcctgtggaagggagtcgttacgctgcagatcggcgccgttacagacgtggctactatggaaggcgc

SEQ ID NO: 5042 - DNA, 80 bp, Homo sapiens
gctggtgagattggagagatgaaggatggagtcccagagggagcacaacttcagggaccggttcatcgaaatccaactta

SEQ ID NO: 5043 - DNA, 500 bp, Homo sapiens
gtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagcc

SEQ ID NO: 5044 - DNA, 87 bp, Homo sapiens
gtgactggcccggatggagttcctgtggaagggagtcgttacgctgcagatcggcgccgttacagacgtggctactatggaaggcgc

SEQ ID NO: 5045 - DNA, 500 bp, Homo sapiens
gtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggatatcggcgtccctacaattaccggcgtcgcccgcgtcctcctaacgctcct

SEQ ID NO: 5046 - DNA, 68 bp, Homo sapiens
ttggccaggttggtgttgaactcctggcctcaagcagtccttctgcgtctgcctcccagagtgctggg

SEQ ID NO: 5047 - DNA, 25 bp, Homo sapiens
tctgtgagcactttcttgctttctg

SEQ ID NO: 5048 - DNA, 261 bp, Homo sapiens
agactggagtacagtggcacgatctcggttcactgcaacctccacctcccgggttcaagcgattcttctgcctcagcctcccgagtagctgggactacaggtgcgcgccaccacgcctggcgaatttctgtatttttagtagagacggagtttcaccatgttggccaggctggtctcgaactcctgacctcgtgatccgccggcctcggcctcccaaagtgctgggattacaggcgtgagccacggtgcccggccaccttc

SEQ ID NO: 5049 - DNA, 36 bp, Homo sapiens
ccagcctgggtgacagagcgagactccatctcaaaa

SEQ ID NO: 5050 - DNA, 206 bp, Homo sapiens
aggttggagtgcagtgacatgatctcggctcaccacaacctccgcctcctggattcaagcaattcttctgcttcagcctcccgagtaggatgcgcaccactgtgcccagctaatatttgtgtttttagtagagatgggctttcaccatgttggccaggctggtcttgaactgctgacctcagatcatccacctgcctcagcctccc

SEQ ID NO: 5051 - DNA, 36 bp, Homo sapiens
accatcctgtgcatttaggtcagatgatacaaaagg

SEQ ID NO: 5052 - DNA, 36 bp, Homo sapiens
agtgtcccagcctttcagattaagttcatccctgca

SEQ ID NO: 5053 - DNA, 439 bp, Homo sapiens
aggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccct

SEQ ID NO: 5054 - DNA, 40 bp, Homo sapiens
accgctgaacttggcaatggtgtacagatattgctgcaaa

SEQ ID NO: 5055 - DNA, 500 bp, Homo sapiens
ggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaa

SEQ ID NO: 5056 - DNA, 77 bp, Homo sapiens
gatgtggaaatgaaaaatggtataacccagggagacaaactacgtgccttaaaaagtcagagacagccacgtacctc

SEQ ID NO: 5057 - DNA, 500 bp, Homo sapiens
acatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctg

SEQ ID NO: 5058 - DNA, 500 bp, Homo sapiens
gctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagac

SEQ ID NO: 5059 - DNA, 500 bp, Homo sapiens
agtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatt

SEQ ID NO: 5060 - DNA, 194 bp, Homo sapiens
gtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggag

SEQ ID NO: 5061 - DNA, 36 bp, Homo sapiens
tcctacccaacacagcaggctgaacaagctccaaac

SEQ ID NO: 5062 - DNA, 36 bp, Homo sapiens
ttttttctttcctcttaggctgaacaagctccaaac

SEQ ID NO: 5063 - DNA, 36 bp, Homo sapiens
gcctatgtcgacgagcagatgacaatgaaaaccaag

SEQ ID NO: 5064 - DNA, 500 bp, Homo sapiens
gcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagaca

SEQ ID NO: 5065 - DNA, 500 bp, Homo sapiens
cagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggt

SEQ ID NO: 5066 - DNA, 500 bp, Homo sapiens
cagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacag

SEQ ID NO: 5067 - DNA, 216 bp, Homo sapiens
acttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccc

SEQ ID NO: 5068 - DNA, 500 bp, Homo sapiens
ctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggca

SEQ ID NO: 5069 - DNA, 26 bp, Homo sapiens
gtactattgggattttcagccccaag

SEQ ID NO: 5070 - DNA, 36 bp, Homo sapiens
tgccttccaccaagccaggatgaggaagtacagaca

SEQ ID NO: 5071 - DNA, 445 bp, Homo sapiens
aaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccag

SEQ ID NO: 5072 - DNA, 258 bp, Homo sapiens
attggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaa

SEQ ID NO: 5073 - DNA, 330 bp, Homo sapiens
gcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaa

SEQ ID NO: 5074 - DNA, 210 bp, Homo sapiens
aaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcc

SEQ ID NO: 5075 - DNA, 142 bp, Homo sapiens
gcatgggacctgcgccgcccaggtggatgcgctcaactcccagaagaagtactttggcagaagcctggaactctacagggagctggacctcaacagtgtgcttctaaaattggggataaaaccatccatcaattactaccaa

SEQ ID NO: 5076 - DNA, 500 bp, Homo sapiens
cctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttc

SEQ ID NO: 5077 - DNA, 167 bp, Homo sapiens
gatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacag

SEQ ID NO: 5078 - DNA, 500 bp, Homo sapiens
tgattgaaagctgtagggacttaccatacggttatgtattgcttggtgatggggtataaaattgtcatgtgaacatcttggagtgcacttacttagctgatacagcccacgacacacatatgctttgtggtatagcctgttgcttcgaggctacaaacctgtacagtgtgtgactctactgagtactgtaggcacctgtatgtaacacaatggtaaggatttgtgtatctaaacatatctcaacatagaaaaggcacagtagaaatgtggtcatatgggaccgccctcgtacatgcaggccttcactgactgaatgtcgtaatgtggcgcatgactgtgtttaaagatttgtccaaatgcagtttaccaggataagcctggaatccgatttcaattgctgtcttttaaagcaggtgtggcaaacgggtggtgatgtgtgtgccagctccactcggtggtggccccagcgctcccatgctccgaaggagtcaggaactgga

SEQ ID NO: 5079 - DNA, 26 bp, Homo sapiens
tggagattacagacagttcactccct

SEQ ID NO: 5080 - DNA, 500 bp, Homo sapiens
atactttattattaaataaagtttagcattaacattagggtttactcctgtgttgtgcggctttggacaaatgcaggagagcaagtcccacccagtgtgctctggagcagccgctggccctaaaccccctgagccatacctccccttcttcctccccttgaacccccaagcaaccgcgaatctcattcctgtctcttaagactaccttttccaaattgtcacgtcgttggaatcatacagtatgtagcctctgcagactggcttcttgcacttagcaatgtatgtttgcagttcctccagtgtcttttcatgactcgacggctcattggtttttgttgctgaaaatattccattgtttggatgtacactttatcccttcacctataacagcttgtattttcgtgtgcagttttatgattactcaaattgcacttgtagatatatcttaacaaacacttcatacaaaataagcataggattattttattcaccaaagtatt

SEQ ID NO: 5081 - DNA, 500 bp, Homo sapiens
agggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaag

SEQ ID NO: 5082 - DNA, 26 bp, Homo sapiens
ggatgtaatagatcgtggcccttcaa

SEQ ID NO: 5083 - DNA, 78 bp, Homo sapiens
gcatgggacctgcgccgcccaggtggatgcgctcaactcccagaagaagtactttggcagaagcctggaactctacag

SEQ ID NO: 5084 - DNA, 36 bp, Homo sapiens
gtgtgcccctcagctcagccccagcaagtgtgtgct

SEQ ID NO: 5085 - DNA, 36 bp, Homo sapiens
ggtcgggggcagcggcagatttgaggcttaagcaac

SEQ ID NO: 5086 - DNA, 49 bp, Homo sapiens
ggtgaagttacgaaacttgtccaaaatcacacaacttgtaaagggcaca

SEQ ID NO: 5087 - DNA, 86 bp, Homo sapiens
ttggccaggctggtctcaaattcaaattcctgacctcgtgattcacctgcctcggcctccgaaagtgctgggattacacacgtgag

SEQ ID NO: 5088 - DNA, 273 bp, Homo sapiens
ttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccag

SEQ ID NO: 5089 - DNA, 63 bp, Homo sapiens
ttggccaggctggtctcaaattcaaattcctgacctcgtgattcacctgcctcggcctccgaa

SEQ ID NO: 5090 - DNA, 36 bp, Homo sapiens
gaggacgaggacgtcaaggataactgggatgacgat

SEQ ID NO: 5091 - DNA, 36 bp, Homo sapiens
tggaagctcatggacaaggtggtgcggttgtgtcag

SEQ ID NO: 5092 - DNA, 212 bp, Homo sapiens
aacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatga

SEQ ID NO: 5093 - DNA, 111 bp, Homo sapiens
gtccctcatcttcagccacatgctggcagaactaaaaggaatctttccaagtggactctttcagggagacacatttcggattactaaagcagatgctgcggaattttggag

SEQ ID NO: 5094 - DNA, 500 bp, Homo sapiens
tgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtccc

SEQ ID NO: 5095 - DNA, 96 bp, Homo sapiens
ccattctccatggccccacaagcttcccttcccccggtgccaccacgacttgaccttctgccgcagcgagtatgtgttccctcaagtgcttctgct

SEQ ID NO: 5096 - DNA, 500 bp, Homo sapiens
cataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgaggg

SEQ ID NO: 5097 - DNA, 500 bp, Homo sapiens
ttagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcc

SEQ ID NO: 5098 - DNA, 90 bp, Homo sapiens
gatctcggcttactgcaacctccgcctcccgggttcaagcaattcccctgcctcagcctcctgagtatctgggattacaggcatgcacca

SEQ ID NO: 5099 - DNA, 330 bp, Homo sapiens
agaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttg

SEQ ID NO: 5100 - DNA, 43 bp, Homo sapiens
ggatgatttccgcgcctgcctgatctccatgggttacaacatg

SEQ ID NO: 5101 - DNA, 109 bp, Homo sapiens
agatctgactgagtgtccctacatgtggccctactgctcccagcccatctactatggaggaatgccgacagttgttaatgtcaccatcctcaacggcatgggagtcaca

SEQ ID NO: 5102 - DNA, 36 bp, Homo sapiens
aacatactgtcctgcaaggtggtgtgtgatgagaac

SEQ ID NO: 5103 - DNA, 500 bp, Homo sapiens
ggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaag

SEQ ID NO: 5104 - DNA, 500 bp, Homo sapiens
agaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctgg

SEQ ID NO: 5105 - DNA, 36 bp, Homo sapiens
tgccctggagtcatcaatcctggagaatgtaaaatt

SEQ ID NO: 5106 - DNA, 36 bp, Homo sapiens
ggcagtctttgtgcgttggcattggaggtgatcctt

SEQ ID NO: 5107 - DNA, 36 bp, Homo sapiens
cagataccctccttccggccgtccctgcccccggct

SEQ ID NO: 5108 - DNA, 36 bp, Homo sapiens
atgcaaagcaactcaaaggtgataaaaacaaaattc

SEQ ID NO: 5109 - DNA, 36 bp, Homo sapiens
ccagccccagcagaaggacccccagcaaccagccca

SEQ ID NO: 5110 - DNA, 136 bp, Homo sapiens
tggatctttactcacaaggaaaacaacagatgcctcatcacaccccccatcagctgcaacagcccccatctcttcagcctacaccacaagtgccgcaagtacagcagtcacagccgtctcaaagctccgaaccatc

SEQ ID NO: 5111 - DNA, 500 bp, Homo sapiens
tgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacc

SEQ ID NO: 5112 - DNA, 252 bp, Homo sapiens
ggtttcaccgtgttggccaggatggtctcatctcctgacctcgtgatccgtccgcttcggcctcccaaagtgctgggattacaggcacgagtcatcacacccggccgcatgtttcttttgaagcttacaagttgatcaattactaaaacaaggtcagtattcaaccagaggagaaaaacctatatccaaaatttttaggcacttaagcatatataactaattgaaactgtccaaataaattttataatgaag

SEQ ID NO: 5113 - DNA, 36 bp, Homo sapiens
tccatctgccctgcccaggctgcagtagccgagagc

SEQ ID NO: 5114 - DNA, 36 bp, Homo sapiens
tattctttgtatttgaagctccataatgggagaagt

SEQ ID NO: 5115 - DNA, 36 bp, Homo sapiens
ccttcaaataacttcagggtgagtctggagaaaaca

SEQ ID NO: 5116 - DNA, 36 bp, Homo sapiens
aaagcactgacaaagaaggagcaccctccggccatg

SEQ ID NO: 5117 - DNA, 36 bp, Homo sapiens
aaagcattcctggaattagagagacaggctggaaac

SEQ ID NO: 5118 - DNA, 119 bp, Homo sapiens
gagaaaagaggaaaatgactgattctcatgttctggaggaggccaagaaaccccgagttatgggggatattccgatggaattaatcaacgaggttatgtctaccatcacggaccctgca

SEQ ID NO: 5119 - DNA, 36 bp, Homo sapiens
gaagttggcttcgtcctgccctgtcctgccctgcca

SEQ ID NO: 5120 - DNA, 477 bp, Homo sapiens
ggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagc

SEQ ID NO: 5121 - DNA, 132 bp, Homo sapiens
ccgggccgggccggcggcgagcgcagcgggggccgcgggcggcggcggcggctcatgcccggcctgtccccgcgaggggcgggcaccgtgactcggctgggcccccagaggcgggcgatgtgaagatgtcag

SEQ ID NO: 5122 - DNA, 25 bp, Homo sapiens
gaggggccgccgcgggctccggggg

SEQ ID NO: 5123 - DNA, 36 bp, Homo sapiens
ttcaagcgattcttctgccagcctcccgagtagctg

SEQ ID NO: 5124 - DNA, 36 bp, Homo sapiens
tagtcttttttacataaggtccccattccaagattt

SEQ ID NO: 5125 - DNA, 36 bp, Homo sapiens
accaggcccggctcctcatggtcctccagccccata

SEQ ID NO: 5126 - DNA, 36 bp, Homo sapiens
aggctcctcctgatccagctaaggcaggaacggatc

SEQ ID NO: 5127 - DNA, 36 bp, Homo sapiens
actattaaacagcttcaggaacgggctggagttaaa

SEQ ID NO: 5128 - DNA, 36 bp, Homo sapiens
tgaagttatttacaattcgtggcactccacaacaga

SEQ ID NO: 5129 - DNA, 36 bp, Homo sapiens
ccaatccctactgcaatggaatccaaggcattgtag

SEQ ID NO: 5130 - DNA, 36 bp, Homo sapiens
ggtcaacagtggtatgaggttgagcgcacagaaagg

SEQ ID NO: 5131 - DNA, 124 bp, Homo sapiens
cagatcagcatatcattcatgtggcatgtggcgagtcccacagtctggccctcagtgaccgaggccagctgttttcttggggtgcagggagtgatggtcagctaggactcatgactactgagga

SEQ ID NO: 5132 - DNA, 500 bp, Homo sapiens
ggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaaga

SEQ ID NO: 5133 - DNA, 36 bp, Homo sapiens
cttctgtgtcctctccagctccctgccgtggccttt

SEQ ID NO: 5134 - DNA, 394 bp, Homo sapiens
tttaaaggatgttgatttgatcccgccttttaatcggatgctgctggaagtcacctttggcaagctgtacgcttgggctgtacagaacattcgaaatgttttgatggatgccagtgccaaatttaaagagcttggtatccagccggttcccctgcaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttg

SEQ ID NO: 5135 - DNA, 500 bp, Homo sapiens
tgcaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagag

SEQ ID NO: 5136 - DNA, 500 bp, Homo sapiens
aaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctaccc

SEQ ID NO: 5137 - DNA, 108 bp, Homo sapiens
ggggtcccgactccgaagtcccatctgcaactcctgggtgctgtctgcatgttcctggcctccaaactcaaagagaccagcccgctgaccgcggagaagctgtgcatt

SEQ ID NO: 5138 - DNA, 36 bp, Homo sapiens
caccaatctcatccacagcacgtctgccatgtctct

SEQ ID NO: 5139 - DNA, 36 bp, Homo sapiens
cagaaactgagcaccaagctgtccgcccagtcagcc

SEQ ID NO: 5140 - DNA, 500 bp, Homo sapiens
ctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggcctt

SEQ ID NO: 5141 - DNA, 36 bp, Homo sapiens
tttcaccatcttggccaggctggtcttgaacgcctg

SEQ ID NO: 5142 - DNA, 242 bp, Homo sapiens
atgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgc

SEQ ID NO: 5143 - DNA, 185 bp, Homo sapiens
tgtgtgtgtgtgtgtgtgtgtgtgtgtgtgtgtgtttgagagacagagagagagacagaagatagaaaggcggagaggcctgtaatgacgtgagagctcccgcctgaatcacatgatttgagtggggcctggatggggagaagagcatttcccgatatggagagatgctggacaaaaggaaaaat

SEQ ID NO: 5144 - DNA, 36 bp, Homo sapiens
tgtgtaccgccacacccggctaatttttagtagaga

SEQ ID NO: 5145 - DNA, 39 bp, Homo sapiens
gcattgctgcgctcccgtgcccaagggagccacgcgccg

SEQ ID NO: 5146 - DNA, 500 bp, Homo sapiens
caggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtatacctatcccaaacctataagaactaatgataatcctaccaccctttgctgactctctttttggactcagcccgcct

SEQ ID NO: 5147 - DNA, 500 bp, Homo sapiens
gagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgact

SEQ ID NO: 5148 - DNA, 367 bp, Homo sapiens
agagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgat

SEQ ID NO: 5149 - DNA, 500 bp, Homo sapiens
aaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggttt

SEQ ID NO: 5150 - DNA, 160 bp, Homo sapiens
gtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctc

SEQ ID NO: 5151 - DNA, 500 bp, Homo sapiens
tcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctc

SEQ ID NO: 5152 - DNA, 36 bp, Homo sapiens
cgggcacagagccccccgctccggtgccctaccaga

SEQ ID NO: 5153 - DNA, 44 bp, Homo sapiens
gcattgcgcagctggagaaggtccgggctgagtgggagcaggag

SEQ ID NO: 5154 - DNA, 277 bp, Homo sapiens
aagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcact

SEQ ID NO: 5155 - DNA, 62 bp, Homo sapiens
atgttggccagaatggttttgaactcctgacctcaagttatctacctgcctcagcctcccaa

SEQ ID NO: 5156 - DNA, 346 bp, Homo sapiens
gtgcaggaaccgtttgtcatggaagccagggagcctggggggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggag

SEQ ID NO: 5157 - DNA, 326 bp, Homo sapiens
gcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctggggggcccacacccacctaccatcttgtccctaacaccagccagtcccaggtggaagaagatgtcagctcgccacctcaaaggtcctccgaaactatgcagctgaagaaggag

SEQ ID NO: 5158 - DNA, 36 bp, Homo sapiens
ctgagtttctgttcccagcacctgcctttgaaggag

SEQ ID NO: 5159 - DNA, 36 bp, Homo sapiens
atgccagcatgaaaccagggaatgtgcagcaatcag

SEQ ID NO: 5160 - DNA, 500 bp, Homo sapiens
ttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaattt

SEQ ID NO: 5161 - DNA, 36 bp, Homo sapiens
cgtgtgccgtgctcccggctcccaggtgcccacgtg

SEQ ID NO: 5162 - DNA, 57 bp, Homo sapiens
ttgcccaggctggtcctgaactcctgggctcaagtgatctgcctgcctcagcctccc

SEQ ID NO: 5163 - DNA, 364 bp, Homo sapiens
gcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaat

SEQ ID NO: 5164 - DNA, 427 bp, Homo sapiens
tccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtg

SEQ ID NO: 5165 - DNA, 475 bp, Homo sapiens
gcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagttt

SEQ ID NO: 5166 - DNA, 36 bp, Homo sapiens
ctctctctcccacctcagcacccgtccgtcccactg

SEQ ID NO: 5167 - DNA, 237 bp, Homo sapiens
gcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcc

SEQ ID NO: 5168 - DNA, 36 bp, Homo sapiens
tctttggatccaactctgataggagatgacaaaaat

SEQ ID NO: 5169 - DNA, 500 bp, Homo sapiens
caggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcga

SEQ ID NO: 5170 - DNA, 500 bp, Homo sapiens
taacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttc

SEQ ID NO: 5171 - DNA, 36 bp, Homo sapiens
accatgaagcagctggaggagttggaggaggaattt

SEQ ID NO: 5172 - DNA, 111 bp, Homo sapiens
cggcccacgtgcgcatgctgcgggtgctgcacgacctcttcttccagcccatggcagaatgcctgttcttccccttggaggagctgcagaacatcttccccagcctggacg

SEQ ID NO: 5173 - DNA, 36 bp, Homo sapiens
gtccggatagggggcaagggtacagctcgcagaaag

SEQ ID NO: 5174 - DNA, 36 bp, Homo sapiens
agagtttgccgaagaatgattctcctgcctcactcc

SEQ ID NO: 5175 - DNA, 173 bp, Homo sapiens
caagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctgg

SEQ ID NO: 5176 - DNA, 36 bp, Homo sapiens
gaggacatcgaccctgagctcgcacggtatctcaac

SEQ ID NO: 5177 - DNA, 63 bp, Homo sapiens
gagacggccctgcaggaggaggaggagctgcagctggccctggcgctgtcacagtcagaggcg

SEQ ID NO: 5178 - DNA, 36 bp, Homo sapiens
ttattccgcagcgtaaaggtaaagttctccttcaga

SEQ ID NO: 5179 - DNA, 500 bp, Homo sapiens
aaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagactt

SEQ ID NO: 5180 - DNA, 36 bp, Homo sapiens
aggcagtgtctggaattggtgagttgttttgttttg

SEQ ID NO: 5181 - DNA, 36 bp, Homo sapiens
ccccacttcatgcctcaggtaggtcttgtcaagggc

SEQ ID NO: 5182 - DNA, 500 bp, Homo sapiens
tggagtcgtgtacctaggagagttatggctgcctctgctgagtcatgcaggttgtcagggaagtgggggaaagctggcagtcacaggcctcacccagctcccacacaaacccaagggccggtcttactcccaccgtgttcccccacaactgccccgagtctgtttccaggcagagggtgagactggcttgaaaatttgccccaaggctgtgcccctcccagcagcgaaagaaaagggctgtagttcttcccccacctgtgaagtctgcatgctggattcgtgcagttgcccaagttctggccaggaggcttctcaccctgtttaaattgttacgaagttcgactagagaattcttctccctgtggagttttatcccttgctcctctggccaccctcccgatggatccctgtggtgccaggcaggaatgggccttctggggacccagcgagctcccacggcctttctgctgcttcctctacccctgtagttcgctctgctg

SEQ ID NO: 5183 - DNA, 36 bp, Homo sapiens
cagactacggactttgtggctgaagatctgccgcct

SEQ ID NO: 5184 - DNA, 36 bp, Homo sapiens
cagactacggactttgtggtgagttcttcctggggt

SEQ ID NO: 5185 - DNA, 36 bp, Homo sapiens
cagactacggactttgtggttgggcatctgccggct

SEQ ID NO: 5186 - DNA, 229 bp, Homo sapiens
atgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaacc

SEQ ID NO: 5187 - DNA, 311 bp, Homo sapiens
aaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaacca

SEQ ID NO: 5188 - DNA, 162 bp, Homo sapiens
gacattgatattgcccaggatggtctcgaactcctgcactcaagcgatcctcccacctcagcctcccaaagtgttaagattacaggcgttgagccactgcacctggccaacgaggctttctgagatggcatacagtggaaaccgttttcgttcatgcctgaa

SEQ ID NO: 5189 - DNA, 36 bp, Homo sapiens
tgcgggagcccccggccgacctttggtcacctcgtt

SEQ ID NO: 5190 - DNA, 500 bp, Homo sapiens
atttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcct

SEQ ID NO: 5191 - DNA, 129 bp, Homo sapiens
cagcaaaaaactcaagagggggaactgaaaattagtgctgtgttttcagtcagtggcagccctcttgctccacagttgactactggctttcagccctcactggcgtcatctggcatgaataaaatgctt

SEQ ID NO: 5192 - DNA, 500 bp, Homo sapiens
cagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaa

SEQ ID NO: 5193 - DNA, 486 bp, Homo sapiens
cagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagca

SEQ ID NO: 5194 - DNA, 500 bp, Homo sapiens
tggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagca

SEQ ID NO: 5195 - DNA, 498 bp, Homo sapiens
cagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgtt

SEQ ID NO: 5196 - DNA, 500 bp, Homo sapiens
gctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctc

SEQ ID NO: 5197 - DNA, 220 bp, Homo sapiens
gctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaac

SEQ ID NO: 5198 - DNA, 500 bp, Homo sapiens
tttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaac

SEQ ID NO: 5199 - DNA, 317 bp, Homo sapiens
cagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaa

SEQ ID NO: 5200 - DNA, 500 bp, Homo sapiens
gctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatg

SEQ ID NO: 5201 - DNA, 156 bp, Homo sapiens
tatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagt

SEQ ID NO: 5202 - DNA, 525 bp, Homo sapiens
taaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtccccc

SEQ ID NO: 5203 - DNA, 36 bp, Homo sapiens
ccaaattcgtaaccagagttaccacaccagctcaaa

SEQ ID NO: 5204 - DNA, 500 bp, Homo sapiens
ggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgtt

SEQ ID NO: 5205 - DNA, 500 bp, Homo sapiens
gggaggctgagtcaggagaatcgcttgagcccaggagatggaggttgcagtgagccaagatcatgccactgcactccagactgggcaacagagggagactccgtctcaaaaactaaaaaaaaaaaatacatttagtatagcggggggtgggggggagaaataatgttatttcctatgcgaatgacgtgtatccctgtacccatggtaaatgtaaatatactgtgtctcttttgggagagccttttagtagaggagtcttatatgagtctctacataagtagtttcacttgagttttgcagtttgaaatcttaaaggagctttaattgacatttattataccaattaagcttggaatggggcaatggatgcatttcccaaaacgtgtgaaagcactaacagcttatattgctgaatgagaatctcctgggtgtaatttagccacttagggaactgcgtgaacactcccaggccattatgatgctgttacagcttcagtgta

SEQ ID NO: 5206 - DNA, 36 bp, Homo sapiens
cgccaggggctccggcataatacaacttctcagaat

SEQ ID NO: 5207 - DNA, 36 bp, Homo sapiens
tgatgaggactgggacagtgaacttgaagatgattt

SEQ ID NO: 5208 - DNA, 229 bp, Homo sapiens
ccgcctccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctg

SEQ ID NO: 5209 - DNA, 500 bp, Homo sapiens
cgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacac

SEQ ID NO: 5210 - DNA, 500 bp, Homo sapiens
tcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggtaatgcatcctgagtgaacctccagggaaaaaatgtgtagcttcaaggctttgtgttccataaagtttcagatttttatttgagcctactaatttgtggttatttaaagaatagagtattagtctcaaatgtactgtttgttaaagacaacttttttcaacaatgttacttat

SEQ ID NO: 5211 - DNA, 500 bp, Homo sapiens
agcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgct

SEQ ID NO: 5212 - DNA, 500 bp, Homo sapiens
gggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacact

SEQ ID NO: 5213 - DNA, 36 bp, Homo sapiens
tgatgctttatggacttggtaagttactaaatgata

SEQ ID NO: 5214 - DNA, 36 bp, Homo sapiens
cttccacaatactacattgtaagtatgcaaaggagt

SEQ ID NO: 5215 - DNA, 36 bp, Homo sapiens
accaatgccaagcgcaagttgtctgatgatccatgt

SEQ ID NO: 5216 - DNA, 36 bp, Homo sapiens
tctttacttaaattctagttgtctgatgatccatgt

SEQ ID NO: 5217 - DNA, 36 bp, Homo sapiens
tgcaattcgcttattaaaaattcctccctgtaaggg

SEQ ID NO: 5218 - DNA, 36 bp, Homo sapiens
cttctactagggagcaaggaccatcccggcacgttt

SEQ ID NO: 5219 - DNA, 36 bp, Homo sapiens
gtggttcagttattacaggtactgtttgatactcag

SEQ ID NO: 5220 - DNA, 36 bp, Homo sapiens
cctgcaccaggactaaagacgttcctgaatatgttt

SEQ ID NO: 5221 - DNA, 36 bp, Homo sapiens
gttttgctagtccacatggaactcttgaccctagtt

SEQ ID NO: 5222 - DNA, 36 bp, Homo sapiens
attattcaacaagaaacgctgcagctgataaattct

SEQ ID NO: 5223 - DNA, 36 bp, Homo sapiens
tgtgtccttgttttgtagctgcagctgataaattct

SEQ ID NO: 5224 - DNA, 36 bp, Homo sapiens
tgtgttgtgtgtatacagcttcaactaactcagaaa

SEQ ID NO: 5225 - DNA, 36 bp, Homo sapiens
tccaaaatgctattttttgtaagtaccacccagcat

SEQ ID NO: 5226 - DNA, 36 bp, Homo sapiens
ttgttcttatttatgcagatcgaccacttatcaata

SEQ ID NO: 5227 - DNA, 366 bp, Homo sapiens
caaaaggctctggaccgctctcttcttgattgcactttccgattacaaggtagaaataaccgcacttgggtagcagagttagtgtttgcaaattgtccacttaatggcacttctactagggagcaaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccagacatacctgctcatctaaatattttctcagaagttcgtgtttataattaccgaaaacttatcttgtgttatggaaccaccaagggaagctca

SEQ ID NO: 5228 - DNA, 366 bp, Homo sapiens
ggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccagacatacctgctcatctaaatattttctcagaagttcgtgtttataattaccgaaaacttatcttgtgttatgga

SEQ ID NO: 5229 - DNA, 70 bp, Homo sapiens
ccccatacactatggtgtcaccaagtggacgagcagggaactggccaggatctcctcaagtgtctggccc

SEQ ID NO: 5230 - DNA, 36 bp, Homo sapiens
aaagtggaaaaatgtgcgaaaattattcctccagac

SEQ ID NO: 5231 - DNA, 500 bp, Homo sapiens
atagcatgcaaatcagcttcatccatcaactggtgcagtctaggctctttgctgatgagaaacctcttcaggatatgtacaactgcctacattctttctgtttatcacttcagttagaagtgttacattcccaaactctaatgttaatccgagaacggtggggagaccttgtgcaggtggaaaggtatcatgctggaaagtgcctctccctttcagtttggaatcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaagatcgaccacttatcaatagaaaaactcctgattgacagtgtccatgcaagagctcatcagaagctccaagaactgaaggccattcttagaggcttcaatgccaatgaaaactcttccatagagact

SEQ ID NO: 5232 - DNA, 36 bp, Homo sapiens
cttccacaatactacattttgtctgatgatccatgt

SEQ ID NO: 5233 - DNA, 36 bp, Homo sapiens; identical to SEQ ID NO: 5221

SEQ ID NO: 5234 - DNA, 500 bp, Homo sapiens
tgtaaatgaggacgataatcccccttctcctataggaggagatatgatggattctttaatatcgcagctccagccaccaccccagcaacagccatttccaaagcagccaggaacatcaggtgcttatcctcttacttcaccccctacatcttatcatagcacagtcaatcagtctccctcaatgatgcacacacagtctccaggaaatctgcatgctgccagctcccccagtggggctttgagagccccatcaccagcgtcatttgttccaactcctcccccatcctcgcatggaatctcaataggaccaggggccagttttgctagtccacatggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcatt

SEQ ID NO: 5235 - DNA, 36 bp, Homo sapiens
gaagaccgccaaagaacatctgaggaaactaagcat

SEQ ID NO: 5236 - DNA, 36 bp, Homo sapiens
cctcctttggccctacaggtcagaatggcggcagtg

SEQ ID NO: 5237 - DNA, 36 bp, Homo sapiens
cctcaagacaccttccgagtgtctgctcactcccct

SEQ ID NO: 5238 - DNA, 36 bp, Homo sapiens
tctcaagacacctcccgagtgtctgctcactcccct

SEQ ID NO: 5239 - DNA, 36 bp, Homo sapiens
cctcaagacaccttccgagtgtgtgctctatcccct

SEQ ID NO: 5240 - DNA, 338 bp, Homo sapiens
gttatcaatactctggctgaccatcgtcatcgtgggactgactttggtggaagtccttggttacttatcattactgtgtttctgagaagttataaatttgccatctccctctgcacaacttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatga

SEQ ID NO: 5241 - DNA, 36 bp, Homo sapiens
aagcctctttgcaaccgggtcagaatggcggcagtg

SEQ ID NO: 5242 - DNA, 109 bp, Homo sapiens
aagacatctttactttatggagacaggtggaaaccaaagttcgagctaaaatccgtaagatgaaggtgacaacaaaagtcaaccgtcatgacaaaatcaatggaaagag

SEQ ID NO: 5243 - DNA, 36 bp, Homo sapiens; identical to SEQ ID NO: 5235

SEQ ID NO: 5244 - DNA, 500 bp, Homo sapiens
gaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccct

SEQ ID NO: 5245 - DNA, 446 bp, Homo sapiens
aagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccgagtgtgtctgctcactccccttccaccctcagcggatgataatctcaagaaactaaggaagaataaataaata

SEQ ID NO: 5246 - DNA, 410 bp, Homo sapiens
gagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccgagtgtgtctgctcactccccttccaccctcagcggatgataatctcaagaaactaaggaagaataaataaata

SEQ ID NO: 5247 - DNA, 36 bp, Homo sapiens; identical to SEQ ID NO: 5237

SEQ ID NO: 5248 - DNA, 500 bp, Homo sapiens
tacttatcattactgtgtttctgagaagttataaatttgccatctccctctgcacaacttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaaga

SEQ ID NO: 5249 - DNA, 249 bp, Homo sapiens
tccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccgagtgtgtctgctcactccccttccaccctcagcggatgataatctcaagaaactaaggaagaataaataaata

SEQ ID NO: 5250 - DNA, 36 bp, Homo sapiens
gactgaccccaccaggaggtaatgcaaccagtgcac

SEQ ID NO: 5251 - DNA, 498 bp, Homo sapiens
aggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaa

SEQ ID NO: 5252 - DNA, 36 bp, Homo sapiens
ctctggggaggcattatgtatattatttccggatca

SEQ ID NO: 5253 - DNA, 81 bp, Homo sapiens
actcaccctcccagtgtgcttgagaaacaaactgcacccactgaactccgcagctagcatccaaatcagcccttgagattt

SEQ ID NO: 5254 - DNA, 451 bp, Homo sapiens
gcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatg

SEQ ID NO: 5255 - DNA, 334 bp, Homo sapiens
gacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttg

SEQ ID NO: 5256 - DNA, 36 bp, Homo sapiens
tcagatgcatgacacaagagccaatgaaaggcccta

SEQ ID NO: 5257 - DNA, 500 bp, Homo sapiens
agtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaa

SEQ ID NO: 5258 - DNA, 36 bp, Homo sapiens
ctcttagcaatccaaaagggagccaagaagggacca

SEQ ID NO: 5259 - DNA, 36 bp, Homo sapiens
aaatgggacaggaggcaggccagttacaaaggcatc

SEQ ID NO: 5260 - DNA, 42 bp, Homo sapiens
gctagtggaagttactgccgcgccaccgagtccggaccggag

SEQ ID NO: 5261 - DNA, 500 bp, Homo sapiens
tatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctca

SEQ ID NO: 5262 - DNA, 36 bp, Homo sapiens
tggaggcatattgctcagacttccaaagcacaagga

SEQ ID NO: 5263 - DNA, 500 bp, Homo sapiens
gtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaa

SEQ ID NO: 5264 - DNA, 359 bp, Homo sapiens
ctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttag

SEQ ID NO: 5265 - DNA, 92 bp, Homo sapiens
ctggggaagatggcggtggctggggcggtgtccggggagccgctggtgcactggtgcacccagcagttgcggaagactttcggcctggatgt

SEQ ID NO: 5266 - DNA, 36 bp, Homo sapiens
atgtggcgcccggcatagtgaacacctacctcttca

SEQ ID NO: 5267 - DNA, 500 bp, Homo sapiens
acatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctgg

SEQ ID NO: 5268 - DNA, 64 bp, Homo sapiens
catttgcctcccgggctcaagcgattctcctgcctcagcctcccaagtagctgggattacaggc

SEQ ID NO: 5269 - DNA, 36 bp, Homo sapiens
agattattttctgtccaggagctcgcccgtcagcga

SEQ ID NO: 5270 - DNA, 36 bp, Homo sapiens
aaaatgtacacatgagaggtttggacaaagaaacct

SEQ ID NO: 5271 - DNA, 500 bp, Homo sapiens
ataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcaccggcttcatttgcagaaggaaatgctgatgaaca

SEQ ID NO: 5272 - DNA, 55 bp, Homo sapiens
atgttggccaggatggtcttgatctcttgacttcatgatctgcccgcctcggcct

SEQ ID NO: 5273 - DNA, 177 bp, Homo sapiens
ttcttttcttttttttttttttttttttgagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaa

SEQ ID NO: 5274 - DNA, 36 bp, Homo sapiens
aagacaacaatgtggaaggtctggcgcacctgatga

SEQ ID NO: 5275 - DNA, 36 bp, Homo sapiens
ctccattatgtcttacagacgccacaggtcatcatc

SEQ ID NO: 5276 - DNA, 36 bp, Homo sapiens
gatttgccctgacaaaaaatgtggaaatgtaaactt

SEQ ID NO: 5277 - DNA, 36 bp, Homo sapiens
gtaatcgatgtggtcgggagaaaacaactgaggcca

SEQ ID NO: 5278 - DNA, 36 bp, Homo sapiens
aattagaagaaagaacaggatatggtggtggtttta

SEQ ID NO: 5279 - DNA, 36 bp, Homo sapiens
gatggtgaatatgatgagtttggacgtaaaaagaaa

SEQ ID NO: 5280 - DNA, 36 bp, Homo sapiens
aaatataagttagatgaggatgaggatgaagatgac

SEQ ID NO: 5281 - DNA, 500 bp, Homo sapiens
cttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaag

SEQ ID NO: 5282 - DNA, 67 bp, Homo sapiens
cattctggttcccgttcaagttcaaaaaagaaataatgtattaaaatttacatcttaaaaaaatcca

SEQ ID NO: 5283 - DNA, 388 bp, Homo sapiens
cccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaa

SEQ ID NO: 5284 - DNA, 500 bp, Homo sapiens
gttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgg

SEQ ID NO: 5285 - DNA, 276 bp, Homo sapiens
actgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcaccata

SEQ ID NO: 5286 - DNA, 317 bp, Homo sapiens
atagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgcta

SEQ ID NO: 5287 - DNA, 500 bp, Homo sapiens
agatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttca

SEQ ID NO: 5288 - DNA, 86 bp, Homo sapiens
tcctgggttcacgccgttctcctgcctcagcctctctgagaagctgggactacaggcgcccgccaccacgcccggctaattttttt

SEQ ID NO: 5289 - DNA, 67 bp, Homo sapiens
ctcgatctcctgacctcgtgatccgcccgccttggcctcccaaggtgctgggattacaagcgtgagc

SEQ ID NO: 5290 - DNA, 62 bp, Homo sapiens
gatctcagctcactgcaacctctacctcccaggttcaagcgattttcctgcctcagcctcct

SEQ ID NO: 5291 - DNA, 36 bp, Homo sapiens
agcggctgctggacgaagaaattagcagagtacgga

SEQ ID NO: 5292 - DNA, 500 bp, Homo sapiens
aggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattg

SEQ ID NO: 5293 - DNA, 258 bp, Homo sapiens
caacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattg

SEQ ID NO: 5294 - DNA, 331 bp, Homo sapiens
atccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcac

SEQ ID NO: 5295 - DNA, 474 bp, Homo sapiens
aagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcac

SEQ ID NO: 5296 - DNA, 36 bp, Homo sapiens
acagagaaactccaccaggtaaaagacaagtgagca

SEQ ID NO: 5297 - DNA, 36 bp, Homo sapiens
gttatggatgtcactgaggtaagattgagtcacaca

SEQ ID NO: 5298 - DNA, 36 bp, Homo sapiens
catgatgaccaactctggcttgttatggagttctgt

SEQ ID NO: 5299 - DNA, 500 bp, Homo sapiens
tctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctc

SEQ ID NO: 5300 - DNA, 500 bp, Homo sapiens
tgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatg

SEQ ID NO: 5301 - DNA, 89 bp, Homo sapiens
tctcgctcccctgttctgtcccgtcgagattccccactgcagggcagtgggcagcagaatagccaggcaggacagagaaactccaccag

SEQ ID NO: 5302 - DNA, 135 bp, Homo sapiens
ggatgagaccagaagccataaggcaagatcctacccggaaaggctcagtggtcaatgtgaatcctaccaacactaggccacagagtgacaccccggagattcgtaaatacaagaagaggtttaactctgagattc

SEQ ID NO: 5303 - DNA, 36 bp, Homo sapiens
aatatgtgattaggaaaagtacagctgctctggaag

SEQ ID NO: 5304 - DNA, 500 bp, Homo sapiens
caatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattg

SEQ ID NO: 5305 - DNA, 500 bp, Homo sapiens
aagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacattta

SEQ ID NO: 5306 - DNA, 225 bp, Homo sapiens
aagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctg

SEQ ID NO: 5307 - DNA, 36 bp, Homo sapiens
ggagggtggcgaggcaggaaggtcatggaggcggag

SEQ ID NO: 5308 - DNA, 36 bp, Homo sapiens
aacgtggagagcttgctggatggcttaaattccttg

SEQ ID NO: 5309 - DNA, 36 bp, Homo sapiens
ctgaatgaaatgcaggcagtaagaatactttttgga

SEQ ID NO: 5310 - DNA, 500 bp, Homo sapiens
gtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaat

SEQ ID NO: 5311 - DNA, 500 bp, Homo sapiens
gttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaaga

SEQ ID NO: 5312 - DNA, 500 bp, Homo sapiens
acactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctga

SEQ ID NO: 5313 - DNA, 500 bp, Homo sapiens
ggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcg

SEQ ID NO: 5314 - DNA, 36 bp, Homo sapiens
atgttgacttaactccaggcaactatccaaaatcct

SEQ ID NO: 5315 - DNA, 386 bp, Homo sapiens
ggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctc

SEQ ID NO: 5316 - DNA, 230 bp, Homo sapiens
acctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaa

SEQ ID NO: 5317 - DNA, 36 bp, Homo sapiens
gccactctttgcgaacaggtctgtctgcctcaaacc

SEQ ID NO: 5318 - DNA, 491 bp, Homo sapiens
gtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccacca

SEQ ID NO: 5319 - DNA, 153 bp, Homo sapiens
tgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctc

SEQ ID NO: 5320 - DNA, 500 bp, Homo sapiens
cccgccactctttgcgaacaggtctgtctgcctcaaacctttccttgagaggagaatcacctttatctcttcttctcggtcatcttcttccttcttcaagagctggaacccctgcaggctcaaggtgtacaaccccagtacccacccctcaaaacagtcctccttctagccctagcatcagccgcctgacctccagaagttcccaaaagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcct

SEQ ID NO: 5321 - DNA, 500 bp, Homo sapiens
gttcccaaaagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagcc

SEQ ID NO: 5322 - DNA, 500 bp, Homo sapiens
tccaaatcccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaatta

SEQ ID NO: 5323 - DNA, 496 bp, Homo sapiens
agattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaatcccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaag

SEQ ID NO: 5324 - DNA, 499 bp, Homo sapiens
tgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctata

SEQ ID NO: 5325 - DNA, 360 bp, Homo sapiens
cagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 5326 - DNA, 189 bp, Homo sapiens
gaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgccca

SEQ ID NO: 5327 - DNA, 500 bp, Homo sapiens
acgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccc

SEQ ID NO: 5328 - DNA, 36 bp, Homo sapiens
gcagccgccgccggccagatccatcatgttacacaa

SEQ ID NO: 5329 - DNA, 82 bp, Homo sapiens
aggctggaatgcaatggcgtaatcttggctcactgcaacctccgcctcctgggttcaagtgattctcgtgcctcagcctccc

SEQ ID NO: 5330 - DNA, 47 bp, Homo sapiens
caagtacgtgcatgacgatggccgagtgtcctaccctttgtgtttca

SEQ ID NO: 5331 - DNA, 319 bp, Homo sapiens
caagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaggtgactggggacttggaaccctaggacctgaacaaccaagactttaaataattttaaatgcaaaaa

SEQ ID NO: 5332 - DNA, 49 bp, Homo sapiens
acgtgtaaagaatggccttaatttcatgtatgaagccccaccaggagct

SEQ ID NO: 5333 - DNA, 500 bp, Homo sapiens
ctgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccacccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtatttttagtagagatggggttggccggctggtttcaaactcctacctcaggtgatccacctgccttggcctcccaaagtgttggg

SEQ ID NO: 5334 - DNA, 36 bp, Homo sapiens
acccatatttgtttgatggtggagttggcatgaact

SEQ ID NO: 5335 - DNA, 87 bp, Homo sapiens
gaccaggctagtcttgaactcctgacctcaggtgatccacccacctcagcctcccagagtggtgggattataagcatgagccaccgt

SEQ ID NO: 5336 - DNA, 36 bp, Homo sapiens
agcaatctccagcctcagcctaagcccagcagtgga

SEQ ID NO: 5337 - DNA, 500 bp, Homo sapiens
gactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttg

SEQ ID NO: 5338 - DNA, 36 bp, Homo sapiens
ccccgagcctgcctctgggcttccttggtgaagggg

SEQ ID NO: 5339 - DNA, 36 bp, Homo sapiens
tttcttggcatctcccaggtgatgtccttgcaaata

SEQ ID NO: 5340 - DNA, 500 bp, Homo sapiens
ccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagact

SEQ ID NO: 5341 - DNA, 36 bp, Homo sapiens
ctctttcaatgacaacgcgtaagaataacgatgctc

SEQ ID NO: 5342 - DNA, 36 bp, Homo sapiens
atggatctgaatcagatggacactcacatgggagtc

SEQ ID NO: 5343 - DNA, 51 bp, Homo sapiens
gtacatcagtcacagacctgcccaatgcctttgatggaccaattaccataa

SEQ ID NO: 5344 - DNA, 81 bp, Homo sapiens
ccactgcttatgaaggaaactggaacccagaagcacaccctcccctcattcaccatgagcatcatgaggaagaagagaccc

SEQ ID NO: 5345 - DNA, 500 bp, Homo sapiens
gctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgta

SEQ ID NO: 5346 - DNA, 36 bp, Homo sapiens
tttcatagaggctggccctattagtgatttccaaaa

SEQ ID NO: 5347 - DNA, 280 bp, Homo sapiens
ttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttg

SEQ ID NO: 5348 - DNA, 500 bp, Homo sapiens
aagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaa

SEQ ID NO: 5349 - DNA, 500 bp, Homo sapiens
catccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttga

SEQ ID NO: 5350 - DNA, 36 bp, Homo sapiens
aggaccgagcccccggggacgttcctcgtgcggaaa

SEQ ID NO: 5351 - DNA, 36 bp, Homo sapiens
ctatgtgttctctcctagatgatcctaccagacaat

SEQ ID NO: 5352 - DNA, 36 bp, Homo sapiens
tgcaaggcgcatgatgaaaaaccaggtgatgaggaa

SEQ ID NO: 5353 - DNA, 221 bp, Homo sapiens
ctgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataatt

SEQ ID NO: 5354 - DNA, 500 bp, Homo sapiens
accccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgtta

SEQ ID NO: 5355 - DNA, 36 bp, Homo sapiens
tggaatgtgcctgcccagctgaatgagtatgtggct

SEQ ID NO: 5356 - DNA, 36 bp, Homo sapiens
ttacggcagattgttatgttccactggtgaatatga

SEQ ID NO: 5357 - DNA, 36 bp, Homo sapiens
gactatgagcttattgacgtgctggtaaacaatgcc

SEQ ID NO: 5358 - DNA, 293 bp, Homo sapiens
gttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaag

SEQ ID NO: 5359 - DNA, 186 bp, Homo sapiens
aaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaat

SEQ ID NO: 5360 - DNA, 380 bp, Homo sapiens
ggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaa

SEQ ID NO: 5361 - DNA, 411 bp, Homo sapiens
aggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttcc

SEQ ID NO: 5362 - DNA, 500 bp, Homo sapiens
ttatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttat

SEQ ID NO: 5363 - DNA, 36 bp, Homo sapiens
aagtagctgggattacaggtgagtgccaccacatct

SEQ ID NO: 5364 - DNA, 456 bp, Homo sapiens
aggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaa

SEQ ID NO: 5365 - DNA, 135 bp, Homo sapiens
aggagcttctccgcctgaccgacgactcccccgtcgacctcctgtgtgcgcctgtcccctcgtgcctgccgtcccctcagctgagaccagaccccgttatcctccaatctgctgatctcattcagtttgaggagc

SEQ ID NO: 5366 - DNA, 500 bp, Homo sapiens
aaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatc

SEQ ID NO: 5367 - DNA, 500 bp, Homo sapiens
gtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttcc

SEQ ID NO: 5368 - DNA, 191 bp, Homo sapiens
tagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaa

SEQ ID NO: 5369 - DNA, 500 bp, Homo sapiens
ctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgt

SEQ ID NO: 5370 - DNA, 25 bp, Homo sapiens
ttgggaattgtctttgcctgctgcc

SEQ ID NO: 5371 - DNA, 36 bp, Homo sapiens
tctcttatcatgttggtggaggtggccgcagccatt

SEQ ID NO: 5372 - DNA, 36 bp, Homo sapiens
aatctgtgttccagtgtgctgtgctggccctcaagt

SEQ ID NO: 5373 - DNA, 36 bp, Homo sapiens
agccatggaaacgtcacagttcatccaacaagcaat

SEQ ID NO: 5374 - DNA, 36 bp, Homo sapiens
gctgtcccattgttcaagctccataatcggagtgct

SEQ ID NO: 5375 - DNA, 36 bp, Homo sapiens
gcagtttcccttcccaagtaacagcaacaagtggga

SEQ ID NO: 5376 - DNA, 36 bp, Homo sapiens
caggattgcccccgacaggtcactcagctctatgtg

SEQ ID NO: 5377 - DNA, 36 bp, Homo sapiens
cttcaagcttaaacctgggaggactcacgaatggca

SEQ ID NO: 5378 - DNA, 36 bp, Homo sapiens
agacgtcaaagattttaggtttgtatgttttacact

SEQ ID NO: 5379 - DNA, 36 bp, Homo sapiens
ctgcagcagcgacactaggtgagacattctgctgca

SEQ ID NO: 5380 - DNA, 500 bp, Homo sapiens
cccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgc

SEQ ID NO: 5381 - DNA, 342 bp, Homo sapiens
catccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatg

SEQ ID NO: 5382 - DNA, 36 bp, Homo sapiens
cttcaagcttaaacctgggagcaggcttttggaaga

SEQ ID NO: 5383 - DNA, 389 bp, Homo sapiens
ctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccacc

SEQ ID NO: 5384 - DNA, 103 bp, Homo sapiens
agccaacgtcctttgaccccaaaccagaaccagcagggacagcaaacggatccccttgtggcagctgcagcagtgaattctgcccttgcatttggacaaggtc

SEQ ID NO: 5385 - DNA, 36 bp, Homo sapiens
cgaaaataccaagcccagctggagaaacagaagtta

SEQ ID NO: 5386 - DNA, 36 bp, Homo sapiens
cagaaagcaacagcagaggtaatcgagcctaacgaa

SEQ ID NO: 5387 - DNA, 36 bp, Homo sapiens
atttgggcaaatgagctttgatcaccagcagcttgc

SEQ ID NO: 5388 - DNA, 500 bp, Homo sapiens
tcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaa

SEQ ID NO: 5389 - DNA, 36 bp, Homo sapiens
ctgtgtgtcagctacaagggtgagaagaacagtgtg

SEQ ID NO: 5390 - DNA, 36 bp, Homo sapiens
atttttttcctttcccaggctaatctgtgaggtgag

SEQ ID NO: 5391 - DNA, 25 bp, Homo sapiens
gacctcaggactttgtgttcatgtt

SEQ ID NO: 5392 - DNA, 36 bp, Homo sapiens
ccagaaatcaacgccaaggtgtgtctgcctcttcat

SEQ ID NO: 5393 - DNA, 500 bp, Homo sapiens
tccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaa

SEQ ID NO: 5394 - DNA, 36 bp, Homo sapiens
tgggtggtttccatttagaccgaggccggttcagaa

SEQ ID NO: 5395 - DNA, 500 bp, Homo sapiens
actgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgca

SEQ ID NO: 5396 - DNA, 500 bp, Homo sapiens
catacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtga

SEQ ID NO: 5397 - DNA, 36 bp, Homo sapiens
atgaatttgaaatccaagatgctgacatcagaagga

SEQ ID NO: 5398 - DNA, 36 bp, Homo sapiens
tctctggtttccatgtagatgctgacatcagaagga

SEQ ID NO: 5399 - DNA, 36 bp, Homo sapiens
ctgtctgtctaccggcaggaggccccaggaatatca

SEQ ID NO: 5400 - DNA, 500 bp, Homo sapiens
cgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaa

SEQ ID NO: 5401 - DNA, 500 bp, Homo sapiens
caatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttg

SEQ ID NO: 5402 - DNA, 507 bp, Homo sapiens
aatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttg

SEQ ID NO: 5403 - DNA, 500 bp, Homo sapiens
aacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatcca

SEQ ID NO: 5404 - DNA, 124 bp, Homo sapiens
aacgaccagagcagtgctgatggtgccagtgaacgtgctgttgccgagctgtggctgcagcacagcctgcagtaccactgcctctcagcccagctccggcccctgctcggggatagacagtata

SEQ ID NO: 5405 - DNA, 500 bp, Homo sapiens
gcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaag

SEQ ID NO: 5406 - DNA, 500 bp, Homo sapiens; identical to SEQ ID NO: 5401

SEQ ID NO: 5407 - DNA, 36 bp, Homo sapiens
gcatgaagcttcccaagcgtgcgtgcacccctacat

SEQ ID NO: 5408 - DNA, 36 bp, Homo sapiens
agcaggatctgggcccagtccccatgtgagagcagc

SEQ ID NO: 5409 - DNA, 36 bp, Homo sapiens
ctgacgctccaccgaaagagtcactggaactggagg

SEQ ID NO: 5410 - DNA, 170 bp, Homo sapiens
acccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgaga

SEQ ID NO: 5411 - DNA, 36 bp, Homo sapiens
ctacagctttcttgctcccttcagcccccagcccct

SEQ ID NO: 5412 - DNA, 117 bp, Homo sapiens
agtcactggaactggaggacccgtcttctgggctgggtgtgaccaagcaggatctgggcccagtccccatgtgagagcagcagaggcggtcttcaacatcctgccagccccacacag

SEQ ID NO: 5413 - DNA, 59 bp, Homo sapiens
cctgtttgaaatgagcaggcactccttggagcaaaagcccactgacgctccaccgaaag

SEQ ID NO: 5414 - DNA, 30 bp, Homo sapiens
cccgtcttctgggctgggtgtgaccaagca

SEQ ID NO: 5415 - DNA, 149 bp, Homo sapiens
ggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaag

SEQ ID NO: 5416 - DNA, 36 bp, Homo sapiens
gcatgaagcttcccaagcctcccaaagtgctaagat

SEQ ID NO: 5417 - DNA, 36 bp, Homo sapiens
cccatccatgcgctgaataacccgatcatcagccag

SEQ ID NO: 5418 - DNA, 36 bp, Homo sapiens
cctacctccgcgtgcgccgtgagtggcccagccctg

SEQ ID NO: 5419 - DNA, 500 bp, Homo sapiens
tcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgcccca

SEQ ID NO: 5420 - DNA, 500 bp, Homo sapiens
aaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctggg

SEQ ID NO: 5421 - DNA, 488 bp, Homo sapiens
tgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 5422 - DNA, 500 bp, Homo sapiens
atcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggct

SEQ ID NO: 5423 - DNA, 217 bp, Homo sapiens
gaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtgg

SEQ ID NO: 5424 - DNA, 500 bp, Homo sapiens
tagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacag

SEQ ID NO: 5425 - DNA, 500 bp, Homo sapiens
gtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctgga

SEQ ID NO: 5426 - DNA, 500 bp, Homo sapiens
ggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttg

SEQ ID NO: 5427 - DNA, 500 bp, Homo sapiens
gaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagagga

SEQ ID NO: 5428 - DNA, 500 bp, Homo sapiens
atctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgat

SEQ ID NO: 5429 - DNA, 500 bp, Homo sapiens
atccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgat

SEQ ID NO: 5430 - DNA, 36 bp, Homo sapiens
tttcacaattgcctacagtttgttgctgctggaggg

SEQ ID NO: 5431 - DNA, 36 bp, Homo sapiens
tttggtggagagatgacgaccaagacctatgattct

SEQ ID NO: 5432 - DNA, 36 bp, Homo sapiens
ctgcagaggatatgggaggtgattgaatacaatcct

SEQ ID NO: 5433 - DNA, 500 bp, Homo sapiens
tcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaa

SEQ ID NO: 5434 - DNA, 387 bp, Homo sapiens
cgcaagaatgcatacaaactccagggctgctctctcctggagagggagggaggggatttaaaaacctgcagcaacatgggggaggaggctgtttgtccttctctctctggggaagtaactcgctcaaactgccttccttgctgagctgcttcgcgtagctttgaggaaggtctagtgaaattggtctttccattacatctggatgtactaccagagagttctgctgctgttgttttttttagcttttctttctttgagtctttaaagggcaattgtcgacactctgcaaacataccgatttgttgtctgcccactttggagtcttcaatctgggcagtaactatttaccctttttcctgctagcctgtccccctctctggattgaag

SEQ ID NO: 5435 - DNA, 36 bp, Homo sapiens
gttgatcatggcctcaaaccacgacagcccaaccct

SEQ ID NO: 5436 - DNA, 36 bp, Homo sapiens
tggccctgggggccgcaggtgagcgatgttgtgctc

SEQ ID NO: 5437 - DNA, 36 bp, Homo sapiens
ggcatgcaggtgacaagggccctgcctccacccctc

SEQ ID NO: 5438 - DNA, 500 bp, Homo sapiens
ctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctat

SEQ ID NO: 5439 - DNA, 36 bp, Homo sapiens
gcgagaacacctgtcaagatgtggacgagtgcagct

SEQ ID NO: 5440 - DNA, 500 bp, Homo sapiens
ccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatg

SEQ ID NO: 5441 - DNA, 54 bp, Homo sapiens
gctgccgctgccgcccaggctggaagcccagacacggaatcccgaataaccaaa

SEQ ID NO: 5442 - DNA, 81 bp, Homo sapiens
ctcagaactcctcgtgtgtcaatgccaccgcctgtcgctgcaatccagggttcagctctttttctgagatcatcaccaccc

SEQ ID NO: 5443 - DNA, 500 bp, Homo sapiens
gtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctca

SEQ ID NO: 5444 - DNA, 500 bp, Homo sapiens
gcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacga

SEQ ID NO: 5445 - DNA, 262 bp, Homo sapiens
caatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactc

SEQ ID NO: 5446 - DNA, 233 bp, Homo sapiens
gatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgactta

SEQ ID NO: 5447 - DNA, 25 bp, Homo sapiens
agtcagggtgaaacttcttttgcca

SEQ ID NO: 5448 - DNA, 36 bp, Homo sapiens
ctcctctactggatctacactctgtcccaggttttt

SEQ ID NO: 5449 - DNA, 143 bp, Homo sapiens
aaacacaaggagccaggattgtgctggcagccaaggaaacagtagtgcctgtttgagttggcagagagggccttggcacctcttgcatccaggcagtcttgtgagatgggggcacatagcactggggaaagcagaactccatt

SEQ ID NO: 5450 - DNA, 36 bp, Homo sapiens
gagacggacttgcttccgtgtgccccctaccaccgg

SEQ ID NO: 5451 - DNA, 36 bp, Homo sapiens
aaagaagctgatgcgcaagtacaccgtgctccggct

SEQ ID NO: 5452 - DNA, 500 bp, Homo sapiens
gactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtca

SEQ ID NO: 5453 - DNA, 500 bp, Homo sapiens
tccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtg

SEQ ID NO: 5454 - DNA, 500 bp, Homo sapiens
cctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacacc

SEQ ID NO: 5455 - DNA, 390 bp, Homo sapiens
aagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacag

SEQ ID NO: 5456 - DNA, 146 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtcta

SEQ ID NO: 5457 - DNA, 500 bp, Homo sapiens
ccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagta

SEQ ID NO: 5458 - DNA, 500 bp, Homo sapiens
cgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggc

SEQ ID NO: 5459 - DNA, 500 bp, Homo sapiens
ttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagctt

SEQ ID NO: 5460 - DNA, 500 bp, Homo sapiens
aatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggag

SEQ ID NO: 5461 - DNA, 36 bp, Homo sapiens
agacctctttgattacagtccccctctacacaagaa

SEQ ID NO: 5462 - DNA, 500 bp, Homo sapiens
tctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaa

SEQ ID NO: 5463 - DNA, 276 bp, Homo sapiens
tctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgt

SEQ ID NO: 5464 - DNA, 500 bp, Homo sapiens
ctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgca

SEQ ID NO: 5465 - DNA, 197 bp, Homo sapiens
gatcttggctcgctgcaacctctgcctcccaggttcaagcgattctcctgcctcagcctcctgagtaactgggattacagggttttgctttgtcacccaggctggagtgcaatgacatgatcacagctcactgcagccatacctcctgggttcgagtgatcttcccacatcagcctcctgagtagctgggactatag

SEQ ID NO: 5466 - DNA, 36 bp, Homo sapiens
cacgacatcgacctaaagatgcagccaccccttcaa

SEQ ID NO: 5467 - DNA, 36 bp, Homo sapiens
cacggccgcccggccacgcatcttcatgatacagtt

SEQ ID NO: 5468 - DNA, 36 bp, Homo sapiens
acggcaggattcggttaggaggaacagcacagcatg

SEQ ID NO: 5469 - DNA, 58 bp, Homo sapiens
attgtccaagctggtctcaaactcctggcctcaagtgatcctctccccttggcctccc

SEQ ID NO: 5470 - DNA, 426 bp, Homo sapiens
gtctgcagtctgcataagaacagttacttcaaggccagtttctctctctacagtgttgtattaaaaaatacatcagtggaggccgggcgcagtggctcacgcctgtaatcccagcactttgggaggccgaggcaggcggatcatgaggtcaggagatcgagaccatcctggctaacacggtgaaaccccgtctctactaaaaatacaaaaaaaatcagccaggcgtggtggtgggcgcctgtagtcccagctactcgggaggctgaggcaggagaatggcgtgaacctgggaggcagagcttgcagtgagctgagatagcaccactgcactccagcccgggcaacagagcgagactctgtctaaaaaaaaaaaaaaaaaaaaatatatatatatatatatatatatatataatcagtgggccgggc

SEQ ID NO: 5471 - DNA, 36 bp, Homo sapiens
ggcgagagacggatgcaggtgacttgacgtggcttt

SEQ ID NO: 5472 - DNA, 36 bp, Homo sapiens
ctctctcgggttcaaaaggtaactgctcaaacctcc

SEQ ID NO: 5473 - DNA, 25 bp, Homo sapiens
acttgagtgacgagctgagaattat

SEQ ID NO: 5474 - DNA, 36 bp, Homo sapiens
agaattatgcagaaaaagttgcttggaaaagatgct

SEQ ID NO: 5475 - DNA, 500 bp, Homo sapiens
gctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcaca

SEQ ID NO: 5476 - DNA, 36 bp, Homo sapiens
ggatgttgaaaatctccagaaatttgtgaaggagca

SEQ ID NO: 5477 - DNA, 26 bp, Homo sapiens
tttatcagcaaagttttggactggat

SEQ ID NO: 5478 - DNA, 36 bp, Homo sapiens
ttgattgcggaacaacagaccaattttaacactgtt

SEQ ID NO: 5479 - DNA, 36 bp, Homo sapiens
gccatctttttatgcaaaagtcagcgtgacaatata

SEQ ID NO: 5480 - DNA, 36 bp, Homo sapiens
ttctgatttgtcctgcagtgctcattcatcactcca

SEQ ID NO: 5481 - DNA, 184 bp, Homo sapiens
aaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggacc

SEQ ID NO: 5482 - DNA, 213 bp, Homo sapiens
tttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaag

SEQ ID NO: 5483 - DNA, 500 bp, Homo sapiens
ctttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatg

SEQ ID NO: 5484 - DNA, 500 bp, Homo sapiens
atgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaa

SEQ ID NO: 5485 - DNA, 498 bp, Homo sapiens
cagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtaca

SEQ ID NO: 5486 - DNA, 500 bp, Homo sapiens
ctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctg

SEQ ID NO: 5487 - DNA, 500 bp, Homo sapiens
gtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactc

SEQ ID NO: 5488 - DNA, 500 bp, Homo sapiens
agcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaa

SEQ ID NO: 5489 - DNA, 500 bp, Homo sapiens
gaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattat

SEQ ID NO: 5490 - DNA, 36 bp, Homo sapiens
ggcgaccggatcatcaaagtcaacggcaccatggtg

SEQ ID NO: 5491 - DNA, 500 bp, Homo sapiens
gtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcgg

SEQ ID NO: 5492 - DNA, 500 bp, Homo sapiens
gtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatatt

SEQ ID NO: 5493 - DNA, 500 bp, Homo sapiens
tcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctca

SEQ ID NO: 5494 - DNA, 500 bp, Homo sapiens
gacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcct

SEQ ID NO: 5495 - DNA, 104 bp, Homo sapiens
gcccaggctggagtacagtggtgcattctctgctcactgcaacttccgcctcctggcttcaagcaattctcctgcctcagcctgccaagtagctgtgattacag

SEQ ID NO: 5496 - DNA, 36 bp, Homo sapiens
cctctgtagatggtccagaagaaatgaaggaagact

SEQ ID NO: 5497 - DNA, 36 bp, Homo sapiens
atgggcaagaagaaaatgacctgccacctggaactc

SEQ ID NO: 5498 - DNA, 36 bp, Homo sapiens
tccaccttcttctggcaggattcccttcaatgaaga

SEQ ID NO: 5499 - DNA, 57 bp, Homo sapiens
tcacccaggctggtctcgaactcctggcctcaagggatcctcccaccttggcatccc

SEQ ID NO: 5500 - DNA, 500 bp, Homo sapiens
gtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaa

SEQ ID NO: 5501 - DNA, 36 bp, Homo sapiens
gagccgctgcacatttcggaatcttctgcggcttgt

SEQ ID NO: 5502 - DNA, 36 bp, Homo sapiens
tttttttttttttcagcctatttgatggctttgcag

SEQ ID NO: 5503 - DNA, 36 bp, Homo sapiens
gtaccttttgtttttcagactgctctggcccattta

SEQ ID NO: 5504 - DNA, 36 bp, Homo sapiens
ttcttgaagatcacactgctattggtcaggaacaat

SEQ ID NO: 5505 - DNA, 36 bp, Homo sapiens
ttcttgaagatcacactggtaagggcaaagttgatc

SEQ ID NO: 5506 - DNA, 36 bp, Homo sapiens
tcaatttggctacaaaagtcgggaacatgccctgtg

SEQ ID NO: 5507 - DNA, 25 bp, Homo sapiens
tctcgctccggagccgctgcacatt

SEQ ID NO: 5508 - DNA, 329 bp, Homo sapiens
tctcgctccggagccgctgcacatttcggaatcttctgcggcttgtccatagtgtgaataaaaactaaatcacatctataattctactgaactggtcatacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttc

SEQ ID NO: 5509 - DNA, 86 bp, Homo sapiens
gctgtccaatctgttgcagtgagtatattaaggatgatatagcaacagagttgccctgtcaccatttctttcacaaaccttgtgtc

SEQ ID NO: 5510 - DNA, 500 bp, Homo sapiens
tgccgccgtcatttcccacctgcggttattgaagcatctgcagctccttcctctgagcctgatcctgatgccccaccttcgaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttaagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcatgtttgcatcaaatgtaaagactgtgttcacaaccgta

SEQ ID NO: 5511 - DNA, 36 bp, Homo sapiens
ggacacgtccaaatatgggtgctgtgaggagcaaag

SEQ ID NO: 5512 - DNA, 500 bp, Homo sapiens
aggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagccc

SEQ ID NO: 5513 - DNA, 308 bp, Homo sapiens
gtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagg

SEQ ID NO: 5514 - DNA, 36 bp, Homo sapiens
ggttgtgtgaagatggagtttcccggaggaaatgac

SEQ ID NO: 5515 - DNA, 36 bp, Homo sapiens
ttcctgtcaggggccgagacattccatacaccaagc

SEQ ID NO: 5516 - DNA, 36 bp, Homo sapiens
ttcctgtcaggggccgaggtgagccagagctgccga

SEQ ID NO: 5517 - DNA, 500 bp, Homo sapiens
aattgtacaatgtctggtttgaaaattatttattgtggtttttgggaaaaagtgttttctgcttttattatggccttcacatcctaggattcaaatttgaatgtgatagctggcacacggagggatttattcaaaaatggcctgaatcacgttgagcagccagcagaacagagcttaaaaaaaaaaaaaaagtctgagccaaatatagtattgtggattagtatgtaatataaatcagtatattgggcttccagcacatcgaaccagtaagcacatcttcatactctatatttgatgccagactttaatattggccttatttatgctgattgcctatgtattacaattttaaaagctattattttgggagagtacagataggaagtttttctttactcaatgtgttgtcactacctatatattactgaataagttgatagctctttgacttgtccaacagtgcgacttctctgattatttttagttcttcttttgagtgc

SEQ ID NO: 5518 - DNA, 228 bp, Homo sapiens
gggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttct

SEQ ID NO: 5519 - DNA, 36 bp, Homo sapiens
tgttatcccagccacagtggtgacctcccgagggct

SEQ ID NO: 5520 - DNA, 500 bp, Homo sapiens
gaattggatccagcaccaccatcacaaactccttctccacctcctatggctactgttgacccagcatctccagcaccagcttcaatagagccccctgccctgtccccatccattgttgttaactccaccctctcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactcca

SEQ ID NO: 5521 - DNA, 36 bp, Homo sapiens
tgatggggagctaagatctgaaaaagaaggaagaga

SEQ ID NO: 5522 - DNA, 36 bp, Homo sapiens
gcctgccaccctgcccagaatctgctggagcagcaa

SEQ ID NO: 5523 - DNA, 500 bp, Homo sapiens
tcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttc

SEQ ID NO: 5524 - DNA, 36 bp, Homo sapiens
ctcttcccagcaggccagggtttccgcccccaacat

SEQ ID NO: 5525 - DNA, 500 bp, Homo sapiens
atgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattg

SEQ ID NO: 5526 - DNA, 109 bp, Homo sapiens
atgttggccagactggtatcgaactcctgacctgaggcaatctgcccaccttggcctcccaaagtgctgggattacaggcatgagccactgtgcccagccgagttcttt

SEQ ID NO: 5527 - DNA, 500 bp, Homo sapiens
agtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactg

SEQ ID NO: 5528 - DNA, 36 bp, Homo sapiens
accatggacccagccctggtcagccctgaaatgccc

SEQ ID NO: 5529 - DNA, 36 bp, Homo sapiens
ccacacaatctgttgaaggtgctacaggctctgcag

SEQ ID NO: 5530 - DNA, 500 bp, Homo sapiens
cccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggt

SEQ ID NO: 5531 - DNA, 500 bp, Homo sapiens
agaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcac

SEQ ID NO: 5532 - DNA, 177 bp, Homo sapiens
tcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcac

SEQ ID NO: 5533 - DNA, 500 bp, Homo sapiens
gagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaa

SEQ ID NO: 5534 - DNA, 500 bp, Homo sapiens
ttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcga

SEQ ID NO: 5535 - DNA, 139 bp, Homo sapiens
tgaaatctgattcaccttccacttctagcatcccccctctcaatgaaacggtatctgcagcttccttactgacgacaaccaatcagcattcatcctccttgggtggcttgagccacagtgaggagattccaaatactac

SEQ ID NO: 5536 - DNA, 500 bp, Homo sapiens
cagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccaggg

SEQ ID NO: 5537 - DNA, 500 bp, Homo sapiens
aagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcc

SEQ ID NO: 5538 - DNA, 500 bp, Homo sapiens
gtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattc

SEQ ID NO: 5539 - DNA, 36 bp, Homo sapiens
cagtcaccttccctggaaattctgctgtccagctgc

SEQ ID NO: 5540 - DNA, 65 bp, Homo sapiens
cctctcccctcggaccctgccccgcagaccctacaaggttctgctggccacactgacaaacctgt

SEQ ID NO: 5541 - DNA, 161 bp, Homo sapiens
gatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaat

SEQ ID NO: 5542 - DNA, 500 bp, Homo sapiens
ccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagacc

SEQ ID NO: 5543 - DNA, 109 bp, Homo sapiens
acacagtcaatcaatagccaacctcaacctgagacaggacagaagagaactcagaatctttttgtcttttggacttcagccatgtccatgatgcctaccctgtgaagat

SEQ ID NO: 5544 - DNA, 56 bp, Homo sapiens
ctctcgatgcaactctatcgtcacagtcaagaaaaataagagacacatggctgagg

SEQ ID NO: 5545 - DNA, 36 bp, Homo sapiens
gaatgcagaactggaccccgttaccacagaagaaca

SEQ ID NO: 5546 - DNA, 190 bp, Homo sapiens
ctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaa

SEQ ID NO: 5547 - DNA, 500 bp, Homo sapiens
tgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttca

SEQ ID NO: 5548 - DNA, 500 bp, Homo sapiens
tgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagac

SEQ ID NO: 5549 - DNA, 36 bp, Homo sapiens
tggatgaggatggggacgagagcattcacaaactga

SEQ ID NO: 5550 - DNA, 36 bp, Homo sapiens
ggtgctctgtcccctcaggtctctgcatggattccc

SEQ ID NO: 5551 - DNA, 36 bp, Homo sapiens
ctagagagtgacttaaaggatgatgatgcagttccc

SEQ ID NO: 5552 - DNA, 26 bp, Homo sapiens
ttcccccagccctatggacccccaca

SEQ ID NO: 5553 - DNA, 36 bp, Homo sapiens
aaaatagttagttaccaggtgattggcgaggacaac

SEQ ID NO: 5554 - DNA, 36 bp, Homo sapiens
cctgctcttgagaatgtgccgatatgtcaaaatatc

SEQ ID NO: 5555 - DNA, 36 bp, Homo sapiens
ccggaaaggggacacctggtacctagtcgatagtcg

SEQ ID NO: 5556 - DNA, 36 bp, Homo sapiens
tctgaagaccaaattgtgtccaaagcagcatatgta

SEQ ID NO: 5557 - DNA, 36 bp, Homo sapiens
gagccaatagcacgaaaggtggttgaacagggtatg

SEQ ID NO: 5558 - DNA, 500 bp, Homo sapiens
ttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatat

SEQ ID NO: 5559 - DNA, 343 bp, Homo sapiens
atggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacatcttattgatgaattggattacatactgttgccaactgaaggttggaataaacttgtcagctggtacacattgatggaaggtcaagagccaatagcac

SEQ ID NO: 5560 - DNA, 500 bp, Homo sapiens
aaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatga

SEQ ID NO: 5561 - DNA, 80 bp, Homo sapiens
tggaagaagatggcggaaggcggagcggcggatctggacacccagcggtctgacatcgcgacgctgctcaaaacctcgct

SEQ ID NO: 5562 - DNA, 208 bp, Homo sapiens
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgata

SEQ ID NO: 5563 - DNA, 466 bp, Homo sapiens
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacatcttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagattta

SEQ ID NO: 5564 - DNA, 500 bp, Homo sapiens
aatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagt

SEQ ID NO: 5565 - DNA, 36 bp, Homo sapiens
ggcttttcgagggacctggcacgtacatcccccgga

SEQ ID NO: 5566 - DNA, 500 bp, Homo sapiens
cgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagaca

SEQ ID NO: 5567 - DNA, 237 bp, Homo sapiens
aaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaa

SEQ ID NO: 5568 - DNA, 500 bp, Homo sapiens
ttaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagca

SEQ ID NO: 5569 - DNA, 102 bp, Homo sapiens
agagactagctgtgtcgcccaggctggagtgcagtgatgaaatcatggctcattatagcctcaaactcctgggctgaaacgatcctcctgcctcagtctccc

SEQ ID NO: 5570 - DNA, 36 bp, Homo sapiens
ctactgaaacagcacaaggtgtggcgaaagtgcagc

SEQ ID NO: 5571 - DNA, 36 bp, Homo sapiens
aacacagccaactgttagacgacggacataagaaag

SEQ ID NO: 5572 - DNA, 36 bp, Homo sapiens
cccaggatgtcatcgaggacctgagtcagaactcca

SEQ ID NO: 5573 - DNA, 25 bp, Homo sapiens
gaactccatcacaggggaacacagc

SEQ ID NO: 5574 - DNA, 500 bp, Homo sapiens
ctgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtggtggagatgcatgacagtgatatatcagcatatacttacgagcgcactttgatgatggaacaaaggtcccagatgcttcggcacatgcggctatccaaaacagagcgagacagagaggcacaattggtgaaagaccgaaactcaatgctacgattgaccagcattggctctgatgaggacgaagagacagaaacctatcaggagaaggtgcacatgacttggaca

SEQ ID NO: 5575 - DNA, 55 bp, Homo sapiens
aggctgaagcagcctcaaactcctgggctcaagccttccttctgcctcaggctcc

SEQ ID NO: 5576 - DNA, 84 bp, Homo sapiens
ttccccaggatggcctcaaacttctgggctcaagcaattctcctgccttggcctcccaaagtgttgggattataggtgtgagcc

SEQ ID NO: 5577 - DNA, 369 bp, Homo sapiens
ggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggcctcccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcg

SEQ ID NO: 5578 - DNA, 78 bp, Homo sapiens
ggctggagagtggtgcaatcttggctcgctgcaacctccatctcccaggttcaagctactctcccgcctcagcctcct

SEQ ID NO: 5579 - DNA, 24 bp, Homo sapiens
gcaggaaaacagtaagtttggaaa

SEQ ID NO: 5580 - DNA, 24 bp, Homo sapiens
tgcaggaaaacagtaagtttggaa

SEQ ID NO: 5581 - DNA, 24 bp, Homo sapiens
gtgcaggaaaacagtaagtttgga

SEQ ID NO: 5582 - DNA, 24 bp, Homo sapiens
cactgtgataggtgagattgcata

SEQ ID NO: 5583 - DNA, 24 bp, Homo sapiens
gcactgtgataggtgagattgcat

SEQ ID NO: 5584 - DNA, 24 bp, Homo sapiens
agcactgtgataggtgagattgca

SEQ ID NO: 5585 - DNA, 25 bp, Homo sapiens
tgatggctggtatgaaggagtctgc

SEQ ID NO: 5586 - DNA, 25 bp, Homo sapiens
ccctgggaactatgttgaatcaatc

SEQ ID NO: 5587 - DNA, 25 bp, Homo sapiens
gtcatactgtgggactattatggtt

SEQ ID NO: 5588 - DNA, 25 bp, Homo sapiens
tgcctcagttgactccacagatacc

SEQ ID NO: 5589 - DNA, 24 bp, Homo sapiens
ctgctcagcctcatgttaatggag

SEQ ID NO: 5590 - DNA, 24 bp, Homo sapiens
gacgaactccctctgtgactgctc

SEQ ID NO: 5591 - DNA, 25 bp, Homo sapiens
actacttcttcgacatcttctggtg

SEQ ID NO: 5592 - DNA, 23 bp, Homo sapiens
accacctctggcaccacttctcc

SEQ ID NO: 5593 - DNA, 25 bp, Homo sapiens
cagtatggcacaatgaccaggcaga

SEQ ID NO: 5594 - DNA, 24 bp, Homo sapiens
gacgaactccctctgtgactgctc

SEQ ID NO: 5595 - DNA, 25 bp, Homo sapiens
tgcctcagttgactccacagatacc

SEQ ID NO: 5596 - DNA, 25 bp, Homo sapiens
tgcctcagttgactccacagatacc

SEQ ID NO: 5597 - DNA, 23 bp, Homo sapiens
accacctctggcaccacttctcc

SEQ ID NO: 5598 - DNA, 25 bp, Homo sapiens
cagtatggcacaatgaccaggcaga

SEQ ID NO: 5599 - DNA, 25 bp, Homo sapiens
ggagaccaaagcctatacaacccaa

SEQ ID NO: 5600 - DNA, 25 bp, Homo sapiens
ctcagcttcggagaatggagtcttc

SEQ ID NO: 5601 - DNA, 25 bp, Homo sapiens
aaggagaaagtggcacgaagagaga

SEQ ID NO: 5602 - DNA, 24 bp, Homo sapiens
gcaagaactggcacactgtcgaga

SEQ ID NO: 5603 - DNA, 23 bp, Homo sapiens
tcagaaaccgccaagtcctccca

SEQ ID NO: 5604 - DNA, 23 bp, Homo sapiens
gggaacactgggacggaatactc

SEQ ID NO: 5605 - DNA, 25 bp, Homo sapiens
ggagaccaaagcctatacaacccaa

SEQ ID NO: 5606 - DNA, 25 bp, Homo sapiens
ctcagcttcggagaatggagtcttc

SEQ ID NO: 5607 - DNA, 24 bp, Homo sapiens
gccaacaatgtactccagttgctg

SEQ ID NO: 5608 - DNA, 23 bp, Homo sapiens
tcagaaaccgccaagtcctccca

SEQ ID NO: 5609 - DNA, 23 bp, Homo sapiens
gaagtcagcatagtccaggcagg

SEQ ID NO: 5610 - DNA, 25 bp, Homo sapiens
acagtggaagtagtggaggaagtgg

SEQ ID NO: 5611 - DNA, 23 bp, Homo sapiens
gaagtcagcatagtccaggcagg

SEQ ID NO: 5612 - DNA, 23 bp, Homo sapiens
aaccctggaacctgttaaacccc

SEQ ID NO: 5613 - DNA, 25 bp, Homo sapiens
aatgactatatgaccagtcctgcta

SEQ ID NO: 5614 - DNA, 25 bp, Homo sapiens
cagtatggcacaatgaccaggcaga

SEQ ID NO: 5615 - DNA, 24 bp, Homo sapiens
gacgaactccctctgtgactgctc

SEQ ID NO: 5616 - DNA, 24 bp, Homo sapiens
ctgctcagcctcatgttaatggag

SEQ ID NO: 5617 - DNA, 24 bp, Homo sapiens
tccccactgaggcctccccgaagc

SEQ ID NO: 5618 - DNA, 24 bp, Homo sapiens
atccccactgaggcctccccgaag

SEQ ID NO: 5619 - DNA, 24 bp, Homo sapiens
catccccactgaggcctccccgaa

SEQ ID NO: 5620 - DNA, 25 bp, Homo sapiens
cagagtgctaggattacaggcgtga

SEQ ID NO: 5621 - DNA, 23 bp, Homo sapiens
gctcaagtgatccacctgcctca

SEQ ID NO: 5622 - DNA, 24 bp, Homo sapiens
cctctcaagtagctgggattacaa

SEQ ID NO: 5623 - DNA, 24 bp, Homo sapiens
acctctcaagtagctgggattaca

SEQ ID NO: 5624 - DNA, 24 bp, Homo sapiens
gacctctcaagtagctgggattac

SEQ ID NO: 5625 - DNA, 24 bp, Homo sapiens
tgtcccgccagaagcctccaccat

SEQ ID NO: 5626 - DNA, 24 bp, Homo sapiens
ctgtcccgccagaagcctccacca

SEQ ID NO: 5627 - DNA, 24 bp, Homo sapiens
cctgtcccgccagaagcctccacc

SEQ ID NO: 5628 - DNA, 25 bp, Homo sapiens
tgatgagcaacttctcttggaactg

SEQ ID NO: 5629 - DNA, 24 bp, Homo sapiens
agccttaatagacaaactcaaagt

SEQ ID NO: 5630 - DNA, 24 bp, Homo sapiens
gacacctactgaggctcctgcaga

SEQ ID NO: 5631 - DNA, 25 bp, Homo sapiens
tcagttggactccatcctctcctcc

SEQ ID NO: 5632 - DNA, 23 bp, Homo sapiens
gttgttgcgagaactggcttgcg

SEQ ID NO: 5633 - DNA, 23 bp, Homo sapiens
cactcactgctgcccatgcctac

SEQ ID NO: 5634 - DNA, 24 bp, Homo sapiens
ctgtgcagtaggtaggcgaggctc

SEQ ID NO: 5635 - DNA, 24 bp, Homo sapiens
cctgtgcagtaggtaggcgaggct

SEQ ID NO: 5636 - DNA, 24 bp, Homo sapiens
acctgtgcagtaggtaggcgaggc

SEQ ID NO: 5637 - DNA, 24 bp, Homo sapiens
tcttcctggctcatcctggctcaa

SEQ ID NO: 5638 - DNA, 24 bp, Homo sapiens
ctccgagtccaaccaaggcaacag

SEQ ID NO: 5639 - DNA, 24 bp, Homo sapiens
tggtctcttcacacggacgcacat

SEQ ID NO: 5640 - DNA, 24 bp, Homo sapiens
tcagctcccaggtactgtatgaat

SEQ ID NO: 5641 - DNA, 24 bp, Homo sapiens
ttcagctcccaggtactgtatgaa

SEQ ID NO: 5642 - DNA, 24 bp, Homo sapiens
attcagctcccaggtactgtatga

SEQ ID NO: 5643 - DNA, 24 bp, Homo sapiens
ctgtcatcacacctcacgattttg

SEQ ID NO: 5644 - DNA, 24 bp, Homo sapiens
gctgtcatcacacctcacgatttt

SEQ ID NO: 5645 - DNA, 24 bp, Homo sapiens
ggctgtcatcacacctcacgattt

SEQ ID NO: 5646 - DNA, 25 bp, Homo sapiens
cggaaggtggacgtggatgaatatg

SEQ ID NO: 5647 - DNA, 25 bp, Homo sapiens
atgtcgaagaacacagtgtcgtcgg

SEQ ID NO: 5648 - DNA, 23 bp, Homo sapiens
gtggacgaagaagatgggggcga

SEQ ID NO: 5649 - DNA, 25 bp, Homo sapiens
cggaaggtggacgtggatgaatatg

SEQ ID NO: 5650 - DNA, 23 bp, Homo sapiens
cgctggtcgggattgggatgtcg

SEQ ID NO: 5651 - DNA, 23 bp, Homo sapiens
gggctgggcttgctgaggtagag

SEQ ID NO: 5652 - DNA, 24 bp, Homo sapiens
aacagcgtcagccagatctcggtg

SEQ ID NO: 5653 - DNA, 24 bp, Homo sapiens
gaacagcgtcagccagatctcggt

SEQ ID NO: 5654 - DNA, 24 bp, Homo sapiens
agaacagcgtcagccagatctcgg

SEQ ID NO: 5655 - DNA, 24 bp, Homo sapiens
gggatgtgaagagcttggagtcag

SEQ ID NO: 5656 - DNA, 24 bp, Homo sapiens
tgggatgtgaagagcttggagtca

SEQ ID NO: 5657 - DNA, 24 bp, Homo sapiens
ctgggatgtgaagagcttggagtc

SEQ ID NO: 5658 - DNA, 24 bp, Homo sapiens
gtgattctcctgcctcagcctctc

SEQ ID NO: 5659 - DNA, 23 bp, Homo sapiens
aggctggagtgtggtgacactac

SEQ ID NO: 5660 - DNA, 23 bp, Homo sapiens
tcactgcagcatctgcctcccgg

SEQ ID NO: 5661 - DNA, 24 bp, Homo sapiens
tgggattacaggagccaagccgcc

SEQ ID NO: 5662 - DNA, 24 bp, Homo sapiens
ctgggattacaggagccaagccgc

SEQ ID NO: 5663 - DNA, 24 bp, Homo sapiens
gctgggattacaggagccaagccg

SEQ ID NO: 5664 - DNA, 24 bp, Homo sapiens
atggatggcggcatgagtatctgg

SEQ ID NO: 5665 - DNA, 25 bp, Homo sapiens
ttggagtcagccttgaaggacctca

SEQ ID NO: 5666 - DNA, 25 bp, Homo sapiens
tgacctgtgaggaatatgttgcctt

SEQ ID NO: 5667 - DNA, 24 bp, Homo sapiens
catcccttcctgtattgctattaa

SEQ ID NO: 5668 - DNA, 24 bp, Homo sapiens
tcatcccttcctgtattgctatta

SEQ ID NO: 5669 - DNA, 24 bp, Homo sapiens
atcatcccttcctgtattgctatt

SEQ ID NO: 5670 - DNA, 24 bp, Homo sapiens
tcattcctgtggtaaggctatttt

SEQ ID NO: 5671 - DNA, 24 bp, Homo sapiens
gtcattcctgtggtaaggctattt

SEQ ID NO: 5672 - DNA, 24 bp, Homo sapiens
tgtcattcctgtggtaaggctatt

SEQ ID NO: 5673 - DNA, 24 bp, Homo sapiens
ttcatccagagtttgctaatccag

SEQ ID NO: 5674 - DNA, 24 bp, Homo sapiens
tttcatccagagtttgctaatcca

SEQ ID NO: 5675 - DNA, 24 bp, Homo sapiens
ttttcatccagagtttgctaatcc

SEQ ID NO: 5676 - DNA, 23 bp, Homo sapiens
ggaggaagatggcgggacggctg

SEQ ID NO: 5677 - DNA, 25 bp, Homo sapiens
ggagggtgatgaaaggtgttgatga

SEQ ID NO: 5678 - DNA, 25 bp, Homo sapiens
atggaaaggtttatggagcaagtga

SEQ ID NO: 5679 - DNA, 25 bp, Homo sapiens
gcagatgtagaagagagcgaaagtg

SEQ ID NO: 5680 - DNA, 25 bp, Homo sapiens
agttattggggttagggaggtgggg

SEQ ID NO: 5681 - DNA, 25 bp, Homo sapiens
attggacctagcatttgtcgtcaca

SEQ ID NO: 5682 - DNA, 25 bp, Homo sapiens
tcatccagagtttgctaatccagac

SEQ ID NO: 5683 - DNA, 25 bp, Homo sapiens
ctctggaggttcaaccatgttcagg

SEQ ID NO: 5684 - DNA, 25 bp, Homo sapiens
aagtgaggaattgagtggtggtaga

SEQ ID NO: 5685 - DNA, 25 bp, Homo sapiens
ttaaagagggtgtacgggagtttct

SEQ ID NO: 5686 - DNA, 25 bp, Homo sapiens
ctacaaggaacttcaggcacatggt

SEQ ID NO: 5687 - DNA, 24 bp, Homo sapiens
tggaggtgaacaaccgcatcatcg

SEQ ID NO: 5688 - DNA, 23 bp, Homo sapiens
cagcctctcagaatacgccagcc

SEQ ID NO: 5689 - DNA, 24 bp, Homo sapiens
ggcacccgcaacatctactacctg

SEQ ID NO: 5690 - DNA, 23 bp, Homo sapiens
aaccgtcacctggcagagcactc

SEQ ID NO: 5691 - DNA, 23 bp, Homo sapiens
gcactcctccccttcctgctact

SEQ ID NO: 5692 - DNA, 23 bp, Homo sapiens
gccgtgttcctggtcctcgttgc

SEQ ID NO: 5693 - DNA, 23 bp, Homo sapiens
ccagaagcaaggctaggagctgc

SEQ ID NO: 5694 - DNA, 24 bp, Homo sapiens
gacaccaatagactccacagcagc

SEQ ID NO: 5695 - DNA, 24 bp, Homo sapiens
gcagaattcagttacccagtggac

SEQ ID NO: 5696 - DNA, 24 bp, Homo sapiens
agcagaattcagttacccagtgga

SEQ ID NO: 5697 - DNA, 24 bp, Homo sapiens
cagcagaattcagttacccagtgg

SEQ ID NO: 5698 - DNA, 24 bp, Homo sapiens
caaaagatccagtgtggtcagccc

SEQ ID NO: 5699 - DNA, 24 bp, Homo sapiens
ccaaaagatccagtgtggtcagcc

SEQ ID NO: 5700 - DNA, 24 bp, Homo sapiens
cccaaaagatccagtgtggtcagc

SEQ ID NO: 5701 - DNA, 25 bp, Homo sapiens
ttacccagtggacaaccaaagagga

SEQ ID NO: 5702 - DNA, 23 bp, Homo sapiens
gacaacttgcctcctccaccagc

SEQ ID NO: 5703 - DNA, 23 bp, Homo sapiens
tatccgccaccaccacagtcaga

SEQ ID NO: 5704 - DNA, 24 bp, Homo sapiens
gtgtaccagaatggcagcattggc

SEQ ID NO: 5705 - DNA, 23 bp, Homo sapiens
tatccgccaccaccacagtcaga

SEQ ID NO: 5706 - DNA, 23 bp, Homo sapiens
gacaacttgcctcctccaccagc

SEQ ID NO: 5707 - DNA, 23 bp, Homo sapiens
tatccgccaccaccacagtcaga

SEQ ID NO: 5708 - DNA, 23 bp, Homo sapiens
gacaacttgcctcctccaccagc

SEQ ID NO: 5709 - DNA, 23 bp, Homo sapiens
ctcctctaggctctccaccaggc

SEQ ID NO: 5710 - DNA, 23 bp, Homo sapiens
tatccgccaccaccacagtcaga

SEQ ID NO: 5711 - DNA, 23 bp, Homo sapiens
gacaacttgcctcctccaccagc

SEQ ID NO: 5712 - DNA, 23 bp, Homo sapiens
gccacctccgcctccaatgatag

SEQ ID NO: 5713 - DNA, 25 bp, Homo sapiens
tcttcaccttctccttccttctccg

SEQ ID NO: 5714 - DNA, 23 bp, Homo sapiens
tatccgccaccaccacagtcaga

SEQ ID NO: 5715 - DNA, 24 bp, Homo sapiens
gtgtaccagaatggcagcattggc

SEQ ID NO: 5716 - DNA, 23 bp, Homo sapiens
tgaggagcagcgggaacaagaga

SEQ ID NO: 5717 - DNA, 23 bp, Homo sapiens
gccaccatcttgtctcgtcgcat

SEQ ID NO: 5718 - DNA, 23 bp, Homo sapiens
aactctttctgcctgctgcccac

SEQ ID NO: 5719 - DNA, 24 bp, Homo sapiens
cgtcccccaagagctcgccggcgc

SEQ ID NO: 5720 - DNA, 24 bp, Homo sapiens
ccgtcccccaagagctcgccggcg

SEQ ID NO: 5721 - DNA, 24 bp, Homo sapiens
gccgtcccccaagagctcgccggc

SEQ ID NO: 5722 - DNA, 24 bp, Homo sapiens
cccccggccggcccggcctcagcc

SEQ ID NO: 5723 - DNA, 24 bp, Homo sapiens
gcccccggccggcccggcctcagc

SEQ ID NO: 5724 - DNA, 24 bp, Homo sapiens
ggcccccggccggcccggcctcag

SEQ ID NO: 5725 - DNA, 24 bp, Homo sapiens
cccccggccggaccctagtgcctc

SEQ ID NO: 5726 - DNA, 24 bp, Homo sapiens
gcccccggccggaccctagtgcct

SEQ ID NO: 5727 - DNA, 24 bp, Homo sapiens
ggcccccggccggaccctagtgcc

SEQ ID NO: 5728 - DNA, 24 bp, Homo sapiens
ccacacaagcgaatctctgccttt

SEQ ID NO: 5729 - DNA, 24 bp, Homo sapiens
ttctggacactgagagggcaatct

SEQ ID NO: 5730 - DNA, 24 bp, Homo sapiens
gggtcctcctccatctttctacag

SEQ ID NO: 5731 - DNA, 24 bp, Homo sapiens
aaggacatatctggacaaggcacc

SEQ ID NO: 5732 - DNA, 24 bp, Homo sapiens
aacattctggtgacaagtggtgga

SEQ ID NO: 5733 - DNA, 24 bp, Homo sapiens
gctaccagatggcacttacacccg

SEQ ID NO: 5734 - DNA, 24 bp, Homo sapiens
aacattctggtgacaagtggtgga

SEQ ID NO: 5735 - DNA, 24 bp, Homo sapiens
aaggacatatctggacaaggcacc

SEQ ID NO: 5736 - DNA, 24 bp, Homo sapiens
gtgaggtggctttactgaggcgac

SEQ ID NO: 5737 - DNA, 24 bp, Homo sapiens
tgattgcccagatatccagtcatg

SEQ ID NO: 5738 - DNA, 24 bp, Homo sapiens
gtgattgcccagatatccagtcat

SEQ ID NO: 5739 - DNA, 24 bp, Homo sapiens
tgtgattgcccagatatccagtca

SEQ ID NO: 5740 - DNA, 24 bp, Homo sapiens
aggagtgtacgtgtgccagttctg

SEQ ID NO: 5741 - DNA, 24 bp, Homo sapiens
gcccagcatctgaccctaaaccaa

SEQ ID NO: 5742 - DNA, 24 bp, Homo sapiens
gtgtcgggatgattcagactgtgc

SEQ ID NO: 5743 - DNA, 24 bp, Homo sapiens
cgctgtcctcggcctcccaaagtg

SEQ ID NO: 5744 - DNA, 24 bp, Homo sapiens
ccgctgtcctcggcctcccaaagt

SEQ ID NO: 5745 - DNA, 24 bp, Homo sapiens
tccgctgtcctcggcctcccaaag

SEQ ID NO: 5746 - DNA, 23 bp, Homo sapiens
ctcagcagcggtgtcccaagttt

SEQ ID NO: 5747 - DNA, 25 bp, Homo sapiens
cgtggaatttggaatgtggaaagga

SEQ ID NO: 5748 - DNA, 25 bp, Homo sapiens
agtcatcctttcctcccctgtagca

SEQ ID NO: 5749 - DNA, 23 bp, Homo sapiens
ctcagcagcggtgtcccaagttt

SEQ ID NO: 5750 - DNA, 25 bp, Homo sapiens
cgtggaatttggaatgtggaaagga

SEQ ID NO: 5751 - DNA, 24 bp, Homo sapiens
aagcccaggaagcacacatcaagg

SEQ ID NO: 5752 - DNA, 25 bp, Homo sapiens
cgtggaatttggaatgtggaaagga

SEQ ID NO: 5753 - DNA, 23 bp, Homo sapiens
ctcagcagcggtgtcccaagttt

SEQ ID NO: 5754 - DNA, 23 bp, Homo sapiens
aaggctcccttgccagcagggtg

SEQ ID NO: 5755 - DNA, 24 bp, Homo sapiens
agaaatccgagggtggcctttcag

SEQ ID NO: 5756 - DNA, 24 bp, Homo sapiens
gagaaatccgagggtggcctttca

SEQ ID NO: 5757 - DNA, 24 bp, Homo sapiens
ggagaaatccgagggtggcctttc

SEQ ID NO: 5758 - DNA, 24 bp, Homo sapiens
ggttcaagcgattctcatgcctta

SEQ ID NO: 5759 - DNA, 24 bp, Homo sapiens
aggttcaagcgattctcatgcctt

SEQ ID NO: 5760 - DNA, 24 bp, Homo sapiens
caggttcaagcgattctcatgcct

SEQ ID NO: 5761 - DNA, 23 bp, Homo sapiens
atctgtccacttcagccgtccaa

SEQ ID NO: 5762 - DNA, 25 bp, Homo sapiens
gccctgacttcttgctgtaactttc

SEQ ID NO: 5763 - DNA, 25 bp, Homo sapiens
caggcagtatcaggtggtcactaca

SEQ ID NO: 5764 - DNA, 25 bp, Homo sapiens
agcctccagaagcagaactcagaca

SEQ ID NO: 5765 - DNA, 25 bp, Homo sapiens
cagaaggactattgggagacagagc

SEQ ID NO: 5766 - DNA, 25 bp, Homo sapiens
gataagacagagcagttagagcagc

SEQ ID NO: 5767 - DNA, 24 bp, Homo sapiens
tcctgcctcagcttccccctataa

SEQ ID NO: 5768 - DNA, 24 bp, Homo sapiens
ttcctgcctcagcttccccctata

SEQ ID NO: 5769 - DNA, 24 bp, Homo sapiens
attcctgcctcagcttccccctat

SEQ ID NO: 5770 - DNA, 24 bp, Homo sapiens
ccacgacgaaggactccttctcct

SEQ ID NO: 5771 - DNA, 24 bp, Homo sapiens
accacgacgaaggactccttctcc

SEQ ID NO: 5772 - DNA, 24 bp, Homo sapiens
caccacgacgaaggactccttctc

SEQ ID NO: 5773 - DNA, 24 bp, Homo sapiens
aagataaaaaaggctgcttcccca

SEQ ID NO: 5774 - DNA, 24 bp, Homo sapiens
aaagataaaaaaggctgcttcccc

SEQ ID NO: 5775 - DNA, 24 bp, Homo sapiens
aaaagataaaaaaggctgcttccc

SEQ ID NO: 5776 - DNA, 24 bp, Homo sapiens
agcccaagaagacgcaaatccaga

SEQ ID NO: 5777 - DNA, 24 bp, Homo sapiens
tagcccaagaagacgcaaatccag

SEQ ID NO: 5778 - DNA, 24 bp, Homo sapiens
gtagcccaagaagacgcaaatcca

SEQ ID NO: 5779 - DNA, 24 bp, Homo sapiens
ccccgtcacagaaccaagagccgg

SEQ ID NO: 5780 - DNA, 24 bp, Homo sapiens
tccccgtcacagaaccaagagccg

SEQ ID NO: 5781 - DNA, 24 bp, Homo sapiens
ctccccgtcacagaaccaagagcc

SEQ ID NO: 5782 - DNA, 25 bp, Homo sapiens
ggttatctccttcagcaagtcctcc

SEQ ID NO: 5783 - DNA, 25 bp, Homo sapiens
cctcttcatctcgttcacggtcacc

SEQ ID NO: 5784 - DNA, 23 bp, Homo sapiens
cgttcgtcagcatccttgtctgg

SEQ ID NO: 5785 - DNA, 24 bp, Homo sapiens
gctcccagaaccttcagtgaaagt

SEQ ID NO: 5786 - DNA, 23 bp, Homo sapiens
acagaaccaagagccggagtcct

SEQ ID NO: 5787 - DNA, 23 bp, Homo sapiens
aagacgatcttcccctgtcagga

SEQ ID NO: 5788 - DNA, 23 bp, Homo sapiens
accaccaccacgacgaaggactc

SEQ ID NO: 5789 - DNA, 25 bp, Homo sapiens
agatactctccttctccacctccaa

SEQ ID NO: 5790 - DNA, 23 bp, Homo sapiens
agcatcaccatctccaccaccaa

SEQ ID NO: 5791 - DNA, 25 bp, Homo sapiens
aacaggataatcggttcagcaacaa

SEQ ID NO: 5792 - DNA, 23 bp, Homo sapiens
cgagcgaggcggcaagatggacg

SEQ ID NO: 5793 - DNA, 23 bp, Homo sapiens
cggcgcggtgtaccctgggatag

SEQ ID NO: 5794 - DNA, 25 bp, Homo sapiens
aacctgaacctataccagagcctaa

SEQ ID NO: 5795 - DNA, 23 bp, Homo sapiens
ccacgatctcggtcacgctccaa

SEQ ID NO: 5796 - DNA, 23 bp, Homo sapiens
tcccgctctccttctcacactcg

SEQ ID NO: 5797 - DNA, 24 bp, Homo sapiens
gccaagaagaatgcctcctccacc

SEQ ID NO: 5798 - DNA, 23 bp, Homo sapiens
cgttcgtcagcatccttgtctgg

SEQ ID NO: 5799 - DNA, 25 bp, Homo sapiens
cctcttcatctcgttcacggtcacc

SEQ ID NO: 5800 - DNA, 25 bp, Homo sapiens
cctcttcatctcgttcacggtcacc

SEQ ID NO: 5801 - DNA, 25 bp, Homo sapiens
ggttatctccttcagcaagtcctcc

SEQ ID NO: 5802 - DNA, 25 bp, Homo sapiens
gcagagacgccaatacagacgacaa

SEQ ID NO: 5803 - DNA, 25 bp, Homo sapiens
ggttatctccttcagcaagtcctcc

SEQ ID NO: 5804 - DNA, 25 bp, Homo sapiens
cctcttcatctcgttcacggtcacc

SEQ ID NO: 5805 - DNA, 23 bp, Homo sapiens
gccatcacctcctgcaactccac

SEQ ID NO: 5806 - DNA, 23 bp, Homo sapiens
ttcaccagcaccgaagcctagaa

SEQ ID NO: 5807 - DNA, 25 bp, Homo sapiens
gcagagacgccaatacagacgacaa

SEQ ID NO: 5808 - DNA, 25 bp, Homo sapiens
catctgactctggctcctcctcctc

SEQ ID NO: 5809 - DNA, 25 bp, Homo sapiens
gcagagacgccaatacagacgacaa

SEQ ID NO: 5810 - DNA, 25 bp, Homo sapiens
catctgactctggctcctcctcctc

SEQ ID NO: 5811 - DNA, 23 bp, Homo sapiens
aagaatggtgaggttggcaggcg

SEQ ID NO: 5812 - DNA, 25 bp, Homo sapiens
gcagagacgccaatacagacgacaa

SEQ ID NO: 5813 - DNA, 23 bp, Homo sapiens
ttcaccagcaccgaagcctagaa

SEQ ID NO: 5814 - DNA, 25 bp, Homo sapiens
ggttatctccttcagcaagtcctcc

SEQ ID NO: 5815 - DNA, 25 bp, Homo sapiens
cctcttcatctcgttcacggtcacc

SEQ ID NO: 5816 - DNA, 23 bp, Homo sapiens
aagaatggtgaggttggcaggcg

SEQ ID NO: 5817 - DNA, 23 bp, Homo sapiens
accaccaccacgacgaaggactc

SEQ ID NO: 5818 - DNA, 25 bp, Homo sapiens
agatactctccttctccacctccaa

SEQ ID NO: 5819 - DNA, 25 bp, Homo sapiens
agatactctccttctccacctccaa

SEQ ID NO: 5820 - DNA, 23 bp, Homo sapiens
agcatcaccatctccaccaccaa

SEQ ID NO: 5821 - DNA, 25 bp, Homo sapiens
tctcccattctccacctcccaaaca

SEQ ID NO: 5822 - DNA, 23 bp, Homo sapiens
agcatcaccatctccaccaccaa

SEQ ID NO: 5823 - DNA, 25 bp, Homo sapiens
cctcagacctcctcaagtcctccac

SEQ ID NO: 5824 - DNA, 25 bp, Homo sapiens
agatactctccttctccacctccaa

SEQ ID NO: 5825 - DNA, 25 bp, Homo sapiens
ggtctcatcctcccgatctgtctcc

SEQ ID NO: 5826 - DNA, 23 bp, Homo sapiens
ctccatcccccgtccagtctcag

SEQ ID NO: 5827 - DNA, 23 bp, Homo sapiens
tgagccagcagctaaaaagcccc

SEQ ID NO: 5828 - DNA, 24 bp, Homo sapiens
attggcaaaattgcagcagagacc

SEQ ID NO: 5829 - DNA, 24 bp, Homo sapiens
aattggcaaaattgcagcagagac

SEQ ID NO: 5830 - DNA, 24 bp, Homo sapiens
caattggcaaaattgcagcagaga

SEQ ID NO: 5831 - DNA, 25 bp, Homo sapiens
gccatcaaatagcaaataccctctg

SEQ ID NO: 5832 - DNA, 25 bp, Homo sapiens
aaggtttatggtgctgctattcagt

SEQ ID NO: 5833 - DNA, 24 bp, Homo sapiens
gcatctgtcttctttctcactggc

SEQ ID NO: 5834 - DNA, 23 bp, Homo sapiens
tgagacagccacagatgcagcct

SEQ ID NO: 5835 - DNA, 25 bp, Homo sapiens
gcagcagagaccgagagatgatgga

SEQ ID NO: 5836 - DNA, 25 bp, Homo sapiens
tcctccaccagatgtcagttgtgtt

SEQ ID NO: 5837 - DNA, 24 bp, Homo sapiens
tgcaaccgacgattcttctactca

SEQ ID NO: 5838 - DNA, 24 bp, Homo sapiens
ctgcaaccgacgattcttctactc

SEQ ID NO: 5839 - DNA, 24 bp, Homo sapiens
cctgcaaccgacgattcttctact

SEQ ID NO: 5840 - DNA, 24 bp, Homo sapiens
acgagtggcaagaggtggagaagg

SEQ ID NO: 5841 - DNA, 24 bp, Homo sapiens
cggctaactctgaggacacgcatt

SEQ ID NO: 5842 - DNA, 24 bp, Homo sapiens
gcaggagagccaggatgtcagcgg

SEQ ID NO: 5843 - DNA, 24 bp, Homo sapiens
ccttaccatgcctactaccgccac

SEQ ID NO: 5844 - DNA, 25 bp, Homo sapiens
atccgacagaacgagatcaacaacc

SEQ ID NO: 5845 - DNA, 23 bp, Homo sapiens
gcaccttctaagccagttgtggg

SEQ ID NO: 5846 - DNA, 23 bp, Homo sapiens
gtgtgttaccgagtggaatgggc

SEQ ID NO: 5847 - DNA, 25 bp, Homo sapiens
agaagaggagaaggagaaggagcgg

SEQ ID NO: 5848 - DNA, 25 bp, Homo sapiens
agtgaggaagttgagatggaggtcg

SEQ ID NO: 5849 - DNA, 25 bp, Homo sapiens
atgctctacagtgatgctccagtga

SEQ ID NO: 5850 - DNA, 25 bp, Homo sapiens
tgcttctgcttcaggttgtcttgcc

SEQ ID NO: 5851 - DNA, 23 bp, Homo sapiens
ctggtgcgagcgtggactgtgac

SEQ ID NO: 5852 - DNA, 24 bp, Homo sapiens
cttgggaacagggaatcgctgtgt

SEQ ID NO: 5853 - DNA, 24 bp, Homo sapiens
gcttgggaacagggaatcgctgtg

SEQ ID NO: 5854 - DNA, 24 bp, Homo sapiens
agcttgggaacagggaatcgctgt

SEQ ID NO: 5855 - DNA, 24 bp, Homo sapiens
cggcaggatgacacagaccacttc

SEQ ID NO: 5856 - DNA, 23 bp, Homo sapiens
acggaagtgtgattggagcctgc

SEQ ID NO: 5857 - DNA, 24 bp, Homo sapiens
gtttgctacactgacctcttgcgg

SEQ ID NO: 5858 - DNA, 25 bp, Homo sapiens
ctcgtgagatacctgaacaccaacc

SEQ ID NO: 5859 - DNA, 25 bp, Homo sapiens
gagcccaagttcgtttaccaagcaa

SEQ ID NO: 5860 - DNA, 23 bp, Homo sapiens
aggcaagcaggaagcagcagatg

SEQ ID NO: 5861 - DNA, 23 bp, Homo sapiens
ctgcctacacctgcgtgagtcgg

SEQ ID NO: 5862 - DNA, 24 bp, Homo sapiens
tggagttcagagacctcaacgcct

SEQ ID NO: 5863 - DNA, 24 bp, Homo sapiens
gacgctttgtggttgatgttcggc

SEQ ID NO: 5864 - DNA, 24 bp, Homo sapiens
ggagctggagaagaccttcacctt

SEQ ID NO: 5865 - DNA, 24 bp, Homo sapiens
gacgctttgtggttgatgttcggc

SEQ ID NO: 5866 - DNA, 24 bp, Homo sapiens
tggagttcagagacctcaacgcct

SEQ ID NO: 5867 - DNA, 24 bp, Homo sapiens
gacgctttgtggttgatgttcggc

SEQ ID NO: 5868 - DNA, 24 bp, Homo sapiens
ggagctggagaagaccttcacctt

SEQ ID NO: 5869 - DNA, 23 bp, Homo sapiens
gagggtcaactttgtggcaggtg

SEQ ID NO: 5870 - DNA, 24 bp, Homo sapiens
gacgctttgtggttgatgttcggc

SEQ ID NO: 5871 - DNA, 24 bp, Homo sapiens
tccatcctcaggtgtttgacttca

SEQ ID NO: 5872 - DNA, 24 bp, Homo sapiens
ctccatcctcaggtgtttgacttc

SEQ ID NO: 5873 - DNA, 24 bp, Homo sapiens
tctccatcctcaggtgtttgactt

SEQ ID NO: 5874 - DNA, 24 bp, Homo sapiens
atcttgctcaggtgtttgacttca

SEQ ID NO: 5875 - DNA, 24 bp, Homo sapiens
gatcttgctcaggtgtttgacttc

SEQ ID NO: 5876 - DNA, 24 bp, Homo sapiens
agatcttgctcaggtgtttgactt

SEQ ID NO: 5877 - DNA, 24 bp, Homo sapiens
cttttgtgtttgttactagtactt

SEQ ID NO: 5878 - DNA, 24 bp, Homo sapiens
tcttttgtgtttgttactagtact

SEQ ID NO: 5879 - DNA, 24 bp, Homo sapiens
ctcttttgtgtttgttactagtac

SEQ ID NO: 5880 - DNA, 24 bp, Homo sapiens
cttttgtgtttgatcaaatattga

SEQ ID NO: 5881 - DNA, 24 bp, Homo sapiens
tcttttgtgtttgatcaaatattg

SEQ ID NO: 5882 - DNA, 24 bp, Homo sapiens
ctcttttgtgtttgatcaaatatt

SEQ ID NO: 5883 - DNA, 24 bp, Homo sapiens
tgctgccattgccaccatcaaaac

SEQ ID NO: 5884 - DNA, 24 bp, Homo sapiens
atgctgccattgccaccatcaaaa

SEQ ID NO: 5885 - DNA, 24 bp, Homo sapiens
aatgctgccattgccaccatcaaa

SEQ ID NO: 5886 - DNA, 24 bp, Homo sapiens
ttattagccagattgtgtcctcca

SEQ ID NO: 5887 - DNA, 24 bp, Homo sapiens
cttattagccagattgtgtcctcc

SEQ ID NO: 5888 - DNA, 24 bp, Homo sapiens
ccttattagccagattgtgtcctc

SEQ ID NO: 5889 - DNA, 25 bp, Homo sapiens
ccagggagacagaaagagagcgaga

SEQ ID NO: 5890 - DNA, 25 bp, Homo sapiens
cctgcctatctcgttgctgcttctc

SEQ ID NO: 5891 - DNA, 25 bp, Homo sapiens
aagacagccagcatatccatcgcag

SEQ ID NO: 5892 - DNA, 24 bp, Homo sapiens
tggaaaatcaagatcatccttgga

SEQ ID NO: 5893 - DNA, 24 bp, Homo sapiens
gtggaaaatcaagatcatccttgg

SEQ ID NO: 5894 - DNA, 24 bp, Homo sapiens
agtggaaaatcaagatcatccttg

SEQ ID NO: 5895 - DNA, 25 bp, Homo sapiens
tgctatacgagataattgccttgac

SEQ ID NO: 5896 - DNA, 25 bp, Homo sapiens
gctggctaagagaaccgaaatcaaa

SEQ ID NO: 5897 - DNA, 25 bp, Homo sapiens
gagaacataccagtaaaggaggaga

SEQ ID NO: 5898 - DNA, 24 bp, Homo sapiens
agaacagaaaggtaagcaccagcc

SEQ ID NO: 5899 - DNA, 24 bp, Homo sapiens
gagaacagaaaggtaagcaccagc

SEQ ID NO: 5900 - DNA, 24 bp, Homo sapiens
agagaacagaaaggtaagcaccag

SEQ ID NO: 5901 - DNA, 25 bp, Homo sapiens
tgatgggaaacaggcaagaagaacc

SEQ ID NO: 5902 - DNA, 24 bp, Homo sapiens
agcaggcacctctgtgggcatata

SEQ ID NO: 5903 - DNA, 25 bp, Homo sapiens
tctcatcaccatcattggactgtca

SEQ ID NO: 5904 - DNA, 24 bp, Homo sapiens
gccatgtaccagcggatctccaac

SEQ ID NO: 5905 - DNA, 24 bp, Homo sapiens
gacctgccacctctctacaccctc

SEQ ID NO: 5906 - DNA, 23 bp, Homo sapiens
gcctttaccacggggaccacctt

SEQ ID NO: 5907 - DNA, 23 bp, Homo sapiens
gttcacaccattctcctgcctca

SEQ ID NO: 5908 - DNA, 23 bp, Homo sapiens
cagttctcctgcctcagcctcct

SEQ ID NO: 5909 - DNA, 24 bp, Homo sapiens
tctcctgacctcgtgatctgcctg

SEQ ID NO: 5910 - DNA, 24 bp, Homo sapiens
gaacctgatcctgcttctgctcca

SEQ ID NO: 5911 - DNA, 25 bp, Homo sapiens
cacttcagcctggttatcagaatgc

SEQ ID NO: 5912 - DNA, 23 bp, Homo sapiens
ctcctgtcgtccctcagccttca

SEQ ID NO: 5913 - DNA, 25 bp, Homo sapiens
cacttcagcctggttatcagaatgc

SEQ ID NO: 5914 - DNA, 25 bp, Homo sapiens
cctgaacctgatcctgcttctgctc

SEQ ID NO: 5915 - DNA, 25 bp, Homo sapiens
cagtgcttctccaatgcccaacagt

SEQ ID NO: 5916 - DNA, 25 bp, Homo sapiens
gcttcctggagattcacgaacaaga

SEQ ID NO: 5917 - DNA, 23 bp, Homo sapiens
atgctgcgtcctcctcaacctgc

SEQ ID NO: 5918 - DNA, 24 bp, Homo sapiens
actgtggagttcattgcttcttca

SEQ ID NO: 5919 - DNA, 24 bp, Homo sapiens
gccgggtcagggttaaaaagatca

SEQ ID NO: 5920 - DNA, 24 bp, Homo sapiens
tgccgggtcagggttaaaaagatc

SEQ ID NO: 5921 - DNA, 24 bp, Homo sapiens
ctgccgggtcagggttaaaaagat

SEQ ID NO: 5922 - DNA, 24 bp, Homo sapiens
gtgcccaggctagtctcaaactcc

SEQ ID NO: 5923 - DNA, 23 bp, Homo sapiens
caagcgatccaccctgccttggc

SEQ ID NO: 5924 - DNA, 24 bp, Homo sapiens
agccttccaaagtgctgggattac

SEQ ID NO: 5925 - DNA, 24 bp, Homo sapiens
cagccttccaaagtgctgggatta

SEQ ID NO: 5926 - DNA, 24 bp, Homo sapiens
ccagccttccaaagtgctgggatt

SEQ ID NO: 5927 - DNA, 24 bp, Homo sapiens
ccaggccatggaggaagttcagaa

SEQ ID NO: 5928 - DNA, 24 bp, Homo sapiens
accaggccatggaggaagttcaga

SEQ ID NO: 5929 - DNA, 24 bp, Homo sapiens
taccaggccatggaggaagttcag

SEQ ID NO: 5930 - DNA, 24 bp, Homo sapiens
cagcctacccggtcctcttttctt

SEQ ID NO: 5931 - DNA, 24 bp, Homo sapiens
acagcctacccggtcctcttttct

SEQ ID NO: 5932 - DNA, 24 bp, Homo sapiens
aacagcctacccggtcctcttttc

SEQ ID NO: 5933 - DNA, 25 bp, Homo sapiens
attctgtgtggcttcaagagactga

SEQ ID NO: 5934 - DNA, 23 bp, Homo sapiens
aatagcctgccaaggaatacacg

SEQ ID NO: 5935 - DNA, 23 bp, Homo sapiens
agagcagtgaccccagcagagag

SEQ ID NO: 5936 - DNA, 25 bp, Homo sapiens
agaagtcttatctctggaggctgga

SEQ ID NO: 5937 - DNA, 24 bp, Homo sapiens
agactgagggactatgaggctggt

SEQ ID NO: 5938 - DNA, 25 bp, Homo sapiens
agcaatgaactcaagagccacatcc

SEQ ID NO: 5939 - DNA, 25 bp, Homo sapiens
agagattcttctgcctcgaccttcc

SEQ ID NO: 5940 - DNA, 23 bp, Homo sapiens
gcccaggctggtttcaaacccct

SEQ ID NO: 5941 - DNA, 24 bp, Homo sapiens
cagtggctcacacctgtaatcccg

SEQ ID NO: 5942 - DNA, 24 bp, Homo sapiens
cgggtggatcatgaggtcaggaga

SEQ ID NO: 5943 - DNA, 24 bp, Homo sapiens
aaccctgcccgaagcagcttagcc

SEQ ID NO: 5944 - DNA, 24 bp, Homo sapiens
gaaccctgcccgaagcagcttagc

SEQ ID NO: 5945 - DNA, 24 bp, Homo sapiens
agaaccctgcccgaagcagcttag

SEQ ID NO: 5946 - DNA, 23 bp, Homo sapiens
aattgcctttgatgttgaagccc

SEQ ID NO: 5947 - DNA, 23 bp, Homo sapiens
agagtctggtcttgcacttcctg

SEQ ID NO: 5948 - DNA, 25 bp, Homo sapiens
gcaagggaagctattttggaacaga

SEQ ID NO: 5949 - DNA, 24 bp, Homo sapiens
gcttcaagcaggtgagagcccaac

SEQ ID NO: 5950 - DNA, 24 bp, Homo sapiens
tgcttcaagcaggtgagagcccaa

SEQ ID NO: 5951 - DNA, 24 bp, Homo sapiens
ttgcttcaagcaggtgagagccca

SEQ ID NO: 5952 - DNA, 25 bp, Homo sapiens
tggttgacacatgcctggaggaaga

SEQ ID NO: 5953 - DNA, 25 bp, Homo sapiens
cctgagtcttcttcctccagatgct

SEQ ID NO: 5954 - DNA, 24 bp, Homo sapiens
ccgagggaccaaggatttaactgc

SEQ ID NO: 5955 - DNA, 25 bp, Homo sapiens
attcctctatgtggttgatacttgc

SEQ ID NO: 5956 - DNA, 23 bp, Homo sapiens
cagcagccacctccttccaacag

SEQ ID NO: 5957 - DNA, 23 bp, Homo sapiens
agaactccagcgagacccttggc

SEQ ID NO: 5958 - DNA, 25 bp, Homo sapiens
gctgtaggactgctggagtgtactt

SEQ ID NO: 5959 - DNA, 25 bp, Homo sapiens
tgatgttcattggtggtcctgctac

SEQ ID NO: 5960 - DNA, 25 bp, Homo sapiens
gcctggaatggtggttggagatgag

SEQ ID NO: 5961 - DNA, 24 bp, Homo sapiens
tgcagaaacatgcggagatggtcc

SEQ ID NO: 5962 - DNA, 24 bp, Homo sapiens
gtgcagaaacatgcggagatggtc

SEQ ID NO: 5963 - DNA, 24 bp, Homo sapiens
cgtgcagaaacatgcggagatggt

SEQ ID NO: 5964 - DNA, 23 bp, Homo sapiens
actcgctgcttgctggtcctgtg

SEQ ID NO: 5965 - DNA, 25 bp, Homo sapiens
acacaggtttgaagttggagcgagc

SEQ ID NO: 5966 - DNA, 25 bp, Homo sapiens
cttctcagtgtcaacagccagcaga

SEQ ID NO: 5967 - DNA, 24 bp, Homo sapiens
ctggtgaccagcctggcagtgagc

SEQ ID NO: 5968 - DNA, 24 bp, Homo sapiens
cctggtgaccagcctggcagtgag

SEQ ID NO: 5969 - DNA, 24 bp, Homo sapiens
gcctggtgaccagcctggcagtga

SEQ ID NO: 5970 - DNA, 24 bp, Homo sapiens
ccggatttcaggcacctattaatg

SEQ ID NO: 5971 - DNA, 24 bp, Homo sapiens
cccggatttcaggcacctattaat

SEQ ID NO: 5972 - DNA, 24 bp, Homo sapiens
ccccggatttcaggcacctattaa

SEQ ID NO: 5973 - DNA, 24 bp, Homo sapiens
gtcccgagcaggtgagtgcccaag

SEQ ID NO: 5974 - DNA, 24 bp, Homo sapiens
ggtcccgagcaggtgagtgcccaa

SEQ ID NO: 5975 - DNA, 24 bp, Homo sapiens
gggtcccgagcaggtgagtgccca

SEQ ID NO: 5976 - DNA, 24 bp, Homo sapiens
acacaacacgggtaagaaagaaca

SEQ ID NO: 5977 - DNA, 24 bp, Homo sapiens
gacacaacacgggtaagaaagaac

SEQ ID NO: 5978 - DNA, 24 bp, Homo sapiens
agacacaacacgggtaagaaagaa

SEQ ID NO: 5979 - DNA, 24 bp, Homo sapiens
caaagaacaagagaaagcagcagc

SEQ ID NO: 5980 - DNA, 24 bp, Homo sapiens
tcaaagaacaagagaaagcagcag

SEQ ID NO: 5981 - DNA, 24 bp, Homo sapiens
atcaaagaacaagagaaagcagca

SEQ ID NO: 5982 - DNA, 24 bp, Homo sapiens
agaaggagaagatttgcagtcctg

SEQ ID NO: 5983 - DNA, 24 bp, Homo sapiens
aagaaggagaagatttgcagtcct

SEQ ID NO: 5984 - DNA, 24 bp, Homo sapiens
gaagaaggagaagatttgcagtcc

SEQ ID NO: 5985 - DNA, 24 bp, Homo sapiens
ggatctccaaggtaaatttcctct

SEQ ID NO: 5986 - DNA, 24 bp, Homo sapiens
aggatctccaaggtaaatttcctc

SEQ ID NO: 5987 - DNA, 24 bp, Homo sapiens
caggatctccaaggtaaatttcct

SEQ ID NO: 5988 - DNA, 25 bp, Homo sapiens
tccttgtctgatggcactcttgttg

SEQ ID NO: 5989 - DNA, 25 bp, Homo sapiens
cgaagagcaaactcatccgttctca

SEQ ID NO: 5990 - DNA, 24 bp, Homo sapiens
taatgaacctcaacttgtaatatc

SEQ ID NO: 5991 - DNA, 25 bp, Homo sapiens
gacctcagtatagccaacaacaagc

SEQ ID NO: 5992 - DNA, 25 bp, Homo sapiens
ctccagatgacttgctatgtccaca

SEQ ID NO: 5993 - DNA, 25 bp, Homo sapiens
gcctggaggagattgatagagcctt

SEQ ID NO: 5994 - DNA, 24 bp, Homo sapiens
gacccgagccgctccgacagagcc

SEQ ID NO: 5995 - DNA, 24 bp, Homo sapiens
cgacccgagccgctccgacagagc

SEQ ID NO: 5996 - DNA, 24 bp, Homo sapiens
ccgacccgagccgctccgacagag

SEQ ID NO: 5997 - DNA, 25 bp, Homo sapiens
tcaaagaacaagagaaagcagcagc

SEQ ID NO: 5998 - DNA, 23 bp, Homo sapiens
ctctacagggcagggtgtcatcg

SEQ ID NO: 5999 - DNA, 24 bp, Homo sapiens
ttgtagtgaacctggaaggcaacg

SEQ ID NO: 6000 - DNA, 23 bp, Homo sapiens
ctctacagggcagggtgtcatcg

SEQ ID NO: 6001 - DNA, 24 bp, Homo sapiens
ttgtagtgaacctggaaggcaacg

SEQ ID NO: 6002 - DNA, 23 bp, Homo sapiens
atcttggtctggcgaacctccga

SEQ ID NO: 6003 - DNA, 23 bp, Homo sapiens
taccagcaccatgagagcagcca

SEQ ID NO: 6004 - DNA, 25 bp, Homo sapiens
cgcagcatgaaggagaatctgtgtc

SEQ ID NO: 6005 - DNA, 23 bp, Homo sapiens
ggctgggaggacctggtaagaag

SEQ ID NO: 6006 - DNA, 24 bp, Homo sapiens
ccgaatggcacatacacagagtcc

SEQ ID NO: 6007 - DNA, 23 bp, Homo sapiens
cctccgacataaatggatgggcg

SEQ ID NO: 6008 - DNA, 24 bp, Homo sapiens
aggctttactggggctacgactcc

SEQ ID NO: 6009 - DNA, 25 bp, Homo sapiens
gcctggaatggatatgattaagcag

SEQ ID NO: 6010 - DNA, 23 bp, Homo sapiens
aggggaggcaacctgttcccaaa

SEQ ID NO: 6011 - DNA, 24 bp, Homo sapiens
cgacaccctcagtaccagcagcgc

SEQ ID NO: 6012 - DNA, 24 bp, Homo sapiens
acgacaccctcagtaccagcagcg

SEQ ID NO: 6013 - DNA, 24 bp, Homo sapiens
gacgacaccctcagtaccagcagc

SEQ ID NO: 6014 - DNA, 24 bp, Homo sapiens
aatcaaaacagacagagtgcctca

SEQ ID NO: 6015 - DNA, 24 bp, Homo sapiens
aaatcaaaacagacagagtgcctc

SEQ ID NO: 6016 - DNA, 24 bp, Homo sapiens
gaaatcaaaacagacagagtgcct

SEQ ID NO: 6017 - DNA, 25 bp, Homo sapiens
ttcaagaggcataagatacagcatt

SEQ ID NO: 6018 - DNA, 23 bp, Homo sapiens
ttgacattgcggtggtgagagcg

SEQ ID NO: 6019 - DNA, 25 bp, Homo sapiens
gggaaatgtggattctcagggaccg

SEQ ID NO: 6020 - DNA, 24 bp, Homo sapiens
cgggcccgcaggtgagcagggcct

SEQ ID NO: 6021 - DNA, 24 bp, Homo sapiens
acgggcccgcaggtgagcagggcc

SEQ ID NO: 6022 - DNA, 24 bp, Homo sapiens
cacgggcccgcaggtgagcagggc

SEQ ID NO: 6023 - DNA, 24 bp, Homo sapiens
ccgtgggctagatgtggaagatgt

SEQ ID NO: 6024 - DNA, 24 bp, Homo sapiens
cccgtgggctagatgtggaagatg

SEQ ID NO: 6025 - DNA, 24 bp, Homo sapiens
tcccgtgggctagatgtggaagat

SEQ ID NO: 6026 - DNA, 23 bp, Homo sapiens
gccagttcacagagcgagcgtgt

SEQ ID NO: 6027 - DNA, 23 bp, Homo sapiens
acttctcactgccacggaccctt

SEQ ID NO: 6028 - DNA, 23 bp, Homo sapiens
cagtggtcccgtgtcagaaggcg

SEQ ID NO: 6029 - DNA, 25 bp, Homo sapiens
ccatgatgacacaggagccaggtat

SEQ ID NO: 6030 - DNA, 23 bp, Homo sapiens
ccaggtgacatctgttcccgagc

SEQ ID NO: 6031 - DNA, 24 bp, Homo sapiens
agagcgtggcgatggaacagtaac

SEQ ID NO: 6032 - DNA, 24 bp, Homo sapiens
tgggactacaggtacgcctcacac

SEQ ID NO: 6033 - DNA, 24 bp, Homo sapiens
ctgggactacaggtacgcctcaca

SEQ ID NO: 6034 - DNA, 24 bp, Homo sapiens
gctgggactacaggtacgcctcac

SEQ ID NO: 6035 - DNA, 24 bp, Homo sapiens
tactaagcagaatgtagctagtga

SEQ ID NO: 6036 - DNA, 24 bp, Homo sapiens
ctactaagcagaatgtagctagtg

SEQ ID NO: 6037 - DNA, 24 bp, Homo sapiens
tctactaagcagaatgtagctagt

SEQ ID NO: 6038 - DNA, 24 bp, Homo sapiens
ttgccgcccagcaagacacgctgg

SEQ ID NO: 6039 - DNA, 24 bp, Homo sapiens
gttgccgcccagcaagacacgctg

SEQ ID NO: 6040 - DNA, 24 bp, Homo sapiens
ggttgccgcccagcaagacacgct

SEQ ID NO: 6041 - DNA, 24 bp, Homo sapiens
cggagctgcagtggaggatgctgg

SEQ ID NO: 6042 - DNA, 24 bp, Homo sapiens
tcggagctgcagtggaggatgctg

SEQ ID NO: 6043 - DNA, 24 bp, Homo sapiens
ctcggagctgcagtggaggatgct

SEQ ID NO: 6044 - DNA, 25 bp, Homo sapiens
atcttcttcttggatgacagtgggc

SEQ ID NO: 6045 - DNA, 25 bp, Homo sapiens
tgggcagtacatctctttttacatg

SEQ ID NO: 6046 - DNA, 23 bp, Homo sapiens
ggccacatggtgctggccttggg

SEQ ID NO: 6047 - DNA, 24 bp, Homo sapiens
gatcccaggaggcatgatgttgca

SEQ ID NO: 6048 - DNA, 24 bp, Homo sapiens
ggatcccaggaggcatgatgttgc

SEQ ID NO: 6049 - DNA, 24 bp, Homo sapiens
aggatcccaggaggcatgatgttg

SEQ ID NO: 6050 - DNA, 24 bp, Homo sapiens
gtggtgtcaaggcatcaataacct

SEQ ID NO: 6051 - DNA, 24 bp, Homo sapiens
agtggtgtcaaggcatcaataacc

SEQ ID NO: 6052 - DNA, 24 bp, Homo sapiens
aagtggtgtcaaggcatcaataac

SEQ ID NO: 6053 - DNA, 24 bp, Homo sapiens
gacagcaggaagtatgtaaatggc

SEQ ID NO: 6054 - DNA, 24 bp, Homo sapiens
ggacagcaggaagtatgtaaatgg

SEQ ID NO: 6055 - DNA, 24 bp, Homo sapiens
gggacagcaggaagtatgtaaatg

SEQ ID NO: 6056 - DNA, 25 bp, Homo sapiens
tgtcaagaactggtatcgggagcat

SEQ ID NO: 6057 - DNA, 24 bp, Homo sapiens
cttcaacctacgctctggtcgcac

SEQ ID NO: 6058 - DNA, 25 bp, Homo sapiens
tcagtcaagagccaggaaccattgc

SEQ ID NO: 6059 - DNA, 24 bp, Homo sapiens
tgaggcaggagaatcgcttgaacc

SEQ ID NO: 6060 - DNA, 23 bp, Homo sapiens
ggcgacagagcgagactccatct

SEQ ID NO: 6061 - DNA, 25 bp, Homo sapiens
gccgatcacttgaggtcaggagttc

SEQ ID NO: 6062 - DNA, 24 bp, Homo sapiens
aggagtttgagatcagcctggcca

SEQ ID NO: 6063 - DNA, 24 bp, Homo sapiens
caggagtttgagatcagcctggcc

SEQ ID NO: 6064 - DNA, 24 bp, Homo sapiens
tcaggagtttgagatcagcctggc

SEQ ID NO: 6065 - DNA, 25 bp, Homo sapiens
cctgccttcatttcaaccacctgtc

SEQ ID NO: 6066 - DNA, 25 bp, Homo sapiens
aacactcctttgtccttggattact

SEQ ID NO: 6067 - DNA, 25 bp, Homo sapiens
acagaagaaattcgtgtctatagct

SEQ ID NO: 6068 - DNA, 25 bp, Homo sapiens
cagctctatgtggtaggtggatcaa

SEQ ID NO: 6069 - DNA, 25 bp, Homo sapiens
tccagaattgagaactaaccgttgt

SEQ ID NO: 6070 - DNA, 25 bp, Homo sapiens
agttatacatcgttggtggctctga

SEQ ID NO: 6071 - DNA, 25 bp, Homo sapiens
agttatacatcgttggtggctctga

SEQ ID NO: 6072 - DNA, 25 bp, Homo sapiens
tcctgtaacaaagttgtggacaagc

SEQ ID NO: 6073 - DNA, 25 bp, Homo sapiens
tggtcaaaaaggactgaaaaattgt

SEQ ID NO: 6074 - DNA, 25 bp, Homo sapiens
gtcggagagattataggcaagcggg

SEQ ID NO: 6075 - DNA, 23 bp, Homo sapiens
ttgagtgttgttggaccatgtgt

SEQ ID NO: 6076 - DNA, 23 bp, Homo sapiens
tggccactgaggtgttgatgtgg

SEQ ID NO: 6077 - DNA, 23 bp, Homo sapiens
aactcaagtgatccgcctgcctc

SEQ ID NO: 6078 - DNA, 23 bp, Homo sapiens
atgttggccaggctggtctcaaa

SEQ ID NO: 6079 - DNA, 23 bp, Homo sapiens
tgggtgacagagcaagactccgt

SEQ ID NO: 6080 - DNA, 25 bp, Homo sapiens
gcctgtctggataaagttgtcttga

SEQ ID NO: 6081 - DNA, 25 bp, Homo sapiens
gcttctctgatgcttgaactctcac

SEQ ID NO: 6082 - DNA, 24 bp, Homo sapiens
aagcatgtcgatgtggcgtcaagt

SEQ ID NO: 6083 - DNA, 24 bp, Homo sapiens
tgaacacacagccagtccgtttct

SEQ ID NO: 6084 - DNA, 24 bp, Homo sapiens
cacaagctccagtcttcctcttcg

SEQ ID NO: 6085 - DNA, 24 bp, Homo sapiens
acacaagctccagtcttcctcttc

SEQ ID NO: 6086 - DNA, 24 bp, Homo sapiens
aacacaagctccagtcttcctctt

SEQ ID NO: 6087 - DNA, 25 bp, Homo sapiens
aatgaagcacctgtggtaaccagtg

SEQ ID NO: 6088 - DNA, 25 bp, Homo sapiens
gcatgtaggaacaccagaatacagt

SEQ ID NO: 6089 - DNA, 25 bp, Homo sapiens
cccattgacccaaatatcagtgatg

SEQ ID NO: 6090 - DNA, 24 bp, Homo sapiens
tgtaactatcggacctcggacagt

SEQ ID NO: 6091 - DNA, 24 bp, Homo sapiens
atgtaactatcggacctcggacag

SEQ ID NO: 6092 - DNA, 24 bp, Homo sapiens
gatgtaactatcggacctcggaca

SEQ ID NO: 6093 - DNA, 25 bp, Homo sapiens
ggagatgtaactatcggacctcgga

SEQ ID NO: 6094 - DNA, 25 bp, Homo sapiens
tcctggagcagttgtatgtgtagaa

SEQ ID NO: 6095 - DNA, 24 bp, Homo sapiens
tccaccctaaagcaagaattattg

SEQ ID NO: 6096 - DNA, 23 bp, Homo sapiens
aatagtgattggcgaagggaacc

SEQ ID NO: 6097 - DNA, 25 bp, Homo sapiens
gtaactatcggacctcggacagtga

SEQ ID NO: 6098 - DNA, 24 bp, Homo sapiens
aagagtgtgaagattgctcctgga

SEQ ID NO: 6099 - DNA, 25 bp, Homo sapiens
acgcctacattcacagtgtccagtt

SEQ ID NO: 6100 - DNA, 25 bp, Homo sapiens
ttcctcaacctccacaccctcaagt

SEQ ID NO: 6101 - DNA, 25 bp, Homo sapiens
gccttccagacaactatgagatcat

SEQ ID NO: 6102 - DNA, 24 bp, Homo sapiens
ctgccttccagacaactatgagat

SEQ ID NO: 6103 - DNA, 24 bp, Homo sapiens
actgccttccagacaactatgaga

SEQ ID NO: 6104 - DNA, 24 bp, Homo sapiens
tactgccttccagacaactatgag

SEQ ID NO: 6105 - DNA, 23 bp, Homo sapiens
gcttgaaggaggcgtctagggct

SEQ ID NO: 6106 - DNA, 25 bp, Homo sapiens
caagggctgtggctgatgatggtaa

SEQ ID NO: 6107 - DNA, 23 bp, Homo sapiens
gctgaacacaggctggctggtgg

SEQ ID NO: 6108 - DNA, 24 bp, Homo sapiens
ccattccccacctggtcctccccc

SEQ ID NO: 6109 - DNA, 24 bp, Homo sapiens
cccattccccacctggtcctcccc

SEQ ID NO: 6110 - DNA, 24 bp, Homo sapiens
ccccattccccacctggtcctccc

SEQ ID NO: 6111 - DNA, 25 bp, Homo sapiens
gatggcttgcctcctgtcttcactg

SEQ ID NO: 6112 - DNA, 25 bp, Homo sapiens
gtggttatacttggtcggagcctgt

SEQ ID NO: 6113 - DNA, 25 bp, Homo sapiens
gttgaggtcttcatacagttcagcc

SEQ ID NO: 6114 - DNA, 25 bp, Homo sapiens
catagtgaggcttatcaggttgagg

SEQ ID NO: 6115 - DNA, 25 bp, Homo sapiens
ggtcttggatcactgaagtctgaat

SEQ ID NO: 6116 - DNA, 25 bp, Homo sapiens
tgtaggttccgtaagttcatgcaag

SEQ ID NO: 6117 - DNA, 24 bp, Homo sapiens
tcttttttcagccacctccactga

SEQ ID NO: 6118 - DNA, 24 bp, Homo sapiens
ctcttttttcagccacctccactg

SEQ ID NO: 6119 - DNA, 24 bp, Homo sapiens
tctcttttttcagccacctccact

SEQ ID NO: 6120 - DNA, 25 bp, Homo sapiens
actattggatggacagcggcagatg

SEQ ID NO: 6121 - DNA, 24 bp, Homo sapiens
gcaaggttctatctgtgaggtagc

SEQ ID NO: 6122 - DNA, 23 bp, Homo sapiens
tttcctcctctctccagtccagc

SEQ ID NO: 6123 - DNA, 25 bp, Homo sapiens
tggcgagagatgtattcagtggagg

SEQ ID NO: 6124 - DNA, 24 bp, Homo sapiens
tgactctcatctctgctgcacgag

SEQ ID NO: 6125 - DNA, 25 bp, Homo sapiens
tctatgcgatctcacctggattgga

SEQ ID NO: 6126 - DNA, 24 bp, Homo sapiens
tcctcccctcctgcctcagcctcc

SEQ ID NO: 6127 - DNA, 24 bp, Homo sapiens
ttcctcccctcctgcctcagcctc

SEQ ID NO: 6128 - DNA, 24 bp, Homo sapiens
tttcctcccctcctgcctcagcct

SEQ ID NO: 6129 - DNA, 25 bp, Homo sapiens
ccaggattacaggcaccctccacta

SEQ ID NO: 6130 - DNA, 25 bp, Homo sapiens
cgaactcctaacctccagtgatcca

SEQ ID NO: 6131 - DNA, 25 bp, Homo sapiens
ccggcctaattacttctttaatccc

SEQ ID NO: 6132 - DNA, 24 bp, Homo sapiens
aaatctttttagggaagcaaaggc

SEQ ID NO: 6133 - DNA, 24 bp, Homo sapiens
gaaatctttttagggaagcaaagg

SEQ ID NO: 6134 - DNA, 24 bp, Homo sapiens
agaaatctttttagggaagcaaag

SEQ ID NO: 6135 - DNA, 25 bp, Homo sapiens
tggacacaaccgataactggcacat

SEQ ID NO: 6136 - DNA, 25 bp, Homo sapiens
ccagcagtgagtgtatgttcagtga

SEQ ID NO: 6137 - DNA, 25 bp, Homo sapiens
agcatcgagatgtagttcctgagca

SEQ ID NO: 6138 - DNA, 24 bp, Homo sapiens
caggaaaaagggtgcttacagcaa

SEQ ID NO: 6139 - DNA, 24 bp, Homo sapiens
acaggaaaaagggtgcttacagca

SEQ ID NO: 6140 - DNA, 24 bp, Homo sapiens
gacaggaaaaagggtgcttacagc

SEQ ID NO: 6141 - DNA, 24 bp, Homo sapiens
atatagatttggtaagaaacttaa

SEQ ID NO: 6142 - DNA, 24 bp, Homo sapiens
gatatagatttggtaagaaactta

SEQ ID NO: 6143 - DNA, 24 bp, Homo sapiens
ggatatagatttggtaagaaactt

SEQ ID NO: 6144 - DNA, 24 bp, Homo sapiens
gtgctatgcagtcggtggtagatg

SEQ ID NO: 6145 - DNA, 24 bp, Homo sapiens
agtgctatgcagtcggtggtagat

SEQ ID NO: 6146 - DNA, 24 bp, Homo sapiens
gagtgctatgcagtcggtggtaga

SEQ ID NO: 6147 - DNA, 24 bp, Homo sapiens
aattcgatgaggatagtggagatt

SEQ ID NO: 6148 - DNA, 24 bp, Homo sapiens
gaattcgatgaggatagtggagat

SEQ ID NO: 6149 - DNA, 24 bp, Homo sapiens
agaattcgatgaggatagtggaga

SEQ ID NO: 6150 - DNA, 25 bp, Homo sapiens
tgacattgaggtgttccagaagatg

SEQ ID NO: 6151 - DNA, 24 bp, Homo sapiens
gggcaaaggtggaaatggaggagg

SEQ ID NO: 6152 - DNA, 25 bp, Homo sapiens
ggtcatcaccaacagaatggagtgg

SEQ ID NO: 6153 - DNA, 25 bp, Homo sapiens
tcagtcgtagagatccagaggagga

SEQ ID NO: 6154 - DNA, 25 bp, Homo sapiens
gcagcataccttgtggatagcatgt

SEQ ID NO: 6155 - DNA, 25 bp, Homo sapiens
gctgctgaaagactgggaatgtatg

SEQ ID NO: 6156 - DNA, 25 bp, Homo sapiens
gaagacacagttggatgataggaca

SEQ ID NO: 6157 - DNA, 23 bp, Homo sapiens
gatgccttattgcgacagatccg

SEQ ID NO: 6158 - DNA, 25 bp, Homo sapiens
gtcaactgatagatgaattggcaga

SEQ ID NO: 6159 - DNA, 24 bp, Homo sapiens
gggcaaaggtggaaatggaggagg

SEQ ID NO: 6160 - DNA, 25 bp, Homo sapiens
ggtcatcaccaacagaatggagtgg

SEQ ID NO: 6161 - DNA, 24 bp, Homo sapiens
gcagtcggtggtagatgattggat

SEQ ID NO: 6162 - DNA, 24 bp, Homo sapiens
gcagacaccacaactcacctccac

SEQ ID NO: 6163 - DNA, 25 bp, Homo sapiens
gtgacagtatgtggttaagcagaga

SEQ ID NO: 6164 - DNA, 23 bp, Homo sapiens
aaacggaaagtggttgagggcat

SEQ ID NO: 6165 - DNA, 24 bp, Homo sapiens
gtctttgcaagcagtcttcaggtt

SEQ ID NO: 6166 - DNA, 24 bp, Homo sapiens
tgtctttgcaagcagtcttcaggt

SEQ ID NO: 6167 - DNA, 24 bp, Homo sapiens
ctgtctttgcaagcagtcttcagg

SEQ ID NO: 6168 - DNA, 25 bp, Homo sapiens
ggtcatcaccaacagaatggagtgg

SEQ ID NO: 6169 - DNA, 23 bp, Homo sapiens
aaagggcaaaggtggaaatggag

SEQ ID NO: 6170 - DNA, 23 bp, Homo sapiens
aacctccttctggtccaaaccga

SEQ ID NO: 6171 - DNA, 25 bp, Homo sapiens
accgagatatagcacttcttgacct

SEQ ID NO: 6172 - DNA, 25 bp, Homo sapiens
tgttcaggctgtaaaggagttgtca

SEQ ID NO: 6173 - DNA, 25 bp, Homo sapiens
atggctggtcctcagtggaagaagt

SEQ ID NO: 6174 - DNA, 25 bp, Homo sapiens
accgagatatagcacttcttgacct

SEQ ID NO: 6175 - DNA, 24 bp, Homo sapiens
gcagtcggtggtagatgattggat

SEQ ID NO: 6176 - DNA, 25 bp, Homo sapiens
ggtcatcaccaacagaatggagtgg

SEQ ID NO: 6177 - DNA, 25 bp, Homo sapiens
atggctggtcctcagtggaagaagt

SEQ ID NO: 6178 - DNA, 25 bp, Homo sapiens
ttcttacaggattgtctgactcaca

SEQ ID NO: 6179 - DNA, 25 bp, Homo sapiens
gtacggcaatgtcaatatagtatca

SEQ ID NO: 6180 - DNA, 25 bp, Homo sapiens
gcagcataccttgtggatagcatgt

SEQ ID NO: 6181 - DNA, 25 bp, Homo sapiens
gctgctgaaagactgggaatgtatg

SEQ ID NO: 6182 - DNA, 25 bp, Homo sapiens
ggagaggaagcactaacagataggc

SEQ ID NO: 6183 - DNA, 25 bp, Homo sapiens
gctgctgaaagactgggaatgtatg

SEQ ID NO: 6184 - DNA, 25 bp, Homo sapiens
ggagaggaagcactaacagataggc

SEQ ID NO: 6185 - DNA, 24 bp, Homo sapiens
acaagcggctgaatgtcatcctcc

SEQ ID NO: 6186 - DNA, 23 bp, Homo sapiens
gatgccttattgcgacagatccg

SEQ ID NO: 6187 - DNA, 25 bp, Homo sapiens
gtcaactgatagatgaattggcaga

SEQ ID NO: 6188 - DNA, 25 bp, Homo sapiens
gtgaagaacctgatgaagatgatgc

SEQ ID NO: 6189 - DNA, 25 bp, Homo sapiens
gtcaactgatagatgaattggcaga

SEQ ID NO: 6190 - DNA, 23 bp, Homo sapiens
gatgccttattgcgacagatccg

SEQ ID NO: 6191 - DNA, 25 bp, Homo sapiens
aggagaagaagacacagttggatga

SEQ ID NO: 6192 - DNA, 25 bp, Homo sapiens
gtgacagtatgtggttaagcagaga

SEQ ID NO: 6193 - DNA, 24 bp, Homo sapiens
gcagacaccacaactcacctccac

SEQ ID NO: 6194 - DNA, 25 bp, Homo sapiens
gcctaatggaagatgatgaagagcc

SEQ ID NO: 6195 - DNA, 24 bp, Homo sapiens
taacttccatgagccaccatgccc

SEQ ID NO: 6196 - DNA, 24 bp, Homo sapiens
ttaacttccatgagccaccatgcc

SEQ ID NO: 6197 - DNA, 24 bp, Homo sapiens
tttaacttccatgagccaccatgc

SEQ ID NO: 6198 - DNA, 24 bp, Homo sapiens
gccgcgccgaggtgagggctgggg

SEQ ID NO: 6199 - DNA, 24 bp, Homo sapiens
cgccgcgccgaggtgagggctggg

SEQ ID NO: 6200 - DNA, 24 bp, Homo sapiens
ccgccgcgccgaggtgagggctgg

SEQ ID NO: 6201 - DNA, 23 bp, Homo sapiens
caaggctggaacgggaacgaggg

SEQ ID NO: 6202 - DNA, 25 bp, Homo sapiens
ggaactttgcccagaaggaactgct

SEQ ID NO: 6203 - DNA, 23 bp, Homo sapiens
gctggaaatggagaagaggctgc

SEQ ID NO: 6204 - DNA, 24 bp, Homo sapiens
cccgcgcgccgaggcatcccaaca

SEQ ID NO: 6205 - DNA, 24 bp, Homo sapiens
gcccgcgcgccgaggcatcccaac

SEQ ID NO: 6206 - DNA, 24 bp, Homo sapiens
cgcccgcgcgccgaggcatcccaa

SEQ ID NO: 6207 - DNA, 24 bp, Homo sapiens
agaaactcggagactctgagagtg

SEQ ID NO: 6208 - DNA, 24 bp, Homo sapiens
cagaaactcggagactctgagagt

SEQ ID NO: 6209 - DNA, 24 bp, Homo sapiens
acagaaactcggagactctgagag

SEQ ID NO: 6210 - DNA, 24 bp, Homo sapiens
gatctactgccttatggattgagg

SEQ ID NO: 6211 - DNA, 24 bp, Homo sapiens
tgatctactgccttatggattgag

SEQ ID NO: 6212 - DNA, 24 bp, Homo sapiens
ttgatctactgccttatggattga

SEQ ID NO: 6213 - DNA, 24 bp, Homo sapiens
ctcatgataaagaccaagaagctg

SEQ ID NO: 6214 - DNA, 24 bp, Homo sapiens
cctcatgataaagaccaagaagct

SEQ ID NO: 6215 - DNA, 24 bp, Homo sapiens
gcctcatgataaagaccaagaagc

SEQ ID NO: 6216 - DNA, 24 bp, Homo sapiens
tgaagctgcatgtaagtccattca

SEQ ID NO: 6217 - DNA, 24 bp, Homo sapiens
atgaagctgcatgtaagtccattc

SEQ ID NO: 6218 - DNA, 24 bp, Homo sapiens
gatgaagctgcatgtaagtccatt

SEQ ID NO: 6219 - DNA, 24 bp, Homo sapiens
caagactgaagaatagctgtattt

SEQ ID NO: 6220 - DNA, 24 bp, Homo sapiens
gcaagactgaagaatagctgtatt

SEQ ID NO: 6221 - DNA, 24 bp, Homo sapiens
tgcaagactgaagaatagctgtat

SEQ ID NO: 6222 - DNA, 25 bp, Homo sapiens
gcaatgatagattccaggactccag

SEQ ID NO: 6223 - DNA, 24 bp, Homo sapiens
cggacgttggaacagactggacac

SEQ ID NO: 6224 - DNA, 23 bp, Homo sapiens
gcacttaacaagaaggcagcatt

SEQ ID NO: 6225 - DNA, 24 bp, Homo sapiens
ctttttttcaggtgagaaggtggc

SEQ ID NO: 6226 - DNA, 24 bp, Homo sapiens
actttttttcaggtgagaaggtgg

SEQ ID NO: 6227 - DNA, 24 bp, Homo sapiens
aactttttttcaggtgagaaggtg

SEQ ID NO: 6228 - DNA, 24 bp, Homo sapiens
tttatttccagacttcacttctaa

SEQ ID NO: 6229 - DNA, 24 bp, Homo sapiens
ttttatttccagacttcacttcta

SEQ ID NO: 6230 - DNA, 24 bp, Homo sapiens
gttttatttccagacttcacttct

SEQ ID NO: 6231 - DNA, 24 bp, Homo sapiens
tttggtaataggacatctccaagt

SEQ ID NO: 6232 - DNA, 24 bp, Homo sapiens
ttttggtaataggacatctccaag

SEQ ID NO: 6233 - DNA, 24 bp, Homo sapiens
tttttggtaataggacatctccaa

SEQ ID NO: 6234 - DNA, 24 bp, Homo sapiens
atatttgaaagctgtgtctgtaaa

SEQ ID NO: 6235 - DNA, 24 bp, Homo sapiens
aatatttgaaagctgtgtctgtaa

SEQ ID NO: 6236 - DNA, 24 bp, Homo sapiens
aaatatttgaaagctgtgtctgta

SEQ ID NO: 6237 - DNA, 24 bp, Homo sapiens
atatcttaaagctgtgtctgtaaa

SEQ ID NO: 6238 - DNA, 24 bp, Homo sapiens
tatatcttaaagctgtgtctgtaa

SEQ ID NO: 6239 - DNA, 24 bp, Homo sapiens
ttatatcttaaagctgtgtctgta

SEQ ID NO: 6240 - DNA, 24 bp, Homo sapiens
ttccattccaggtggctgcttctt

SEQ ID NO: 6241 - DNA, 24 bp, Homo sapiens
gttccattccaggtggctgcttct

SEQ ID NO: 6242 - DNA, 24 bp, Homo sapiens
tgttccattccaggtggctgcttc

SEQ ID NO: 6243 - DNA, 24 bp, Homo sapiens
gtatattataggtgggattcttaa

SEQ ID NO: 6244 - DNA, 24 bp, Homo sapiens
tgtatattataggtgggattctta

SEQ ID NO: 6245 - DNA, 24 bp, Homo sapiens
ttgtatattataggtgggattctt

SEQ ID NO: 6246 - DNA, 24 bp, Homo sapiens
ggaatctgaaggcaggagtccaat

SEQ ID NO: 6247 - DNA, 24 bp, Homo sapiens
tggaatctgaaggcaggagtccaa

SEQ ID NO: 6248 - DNA, 24 bp, Homo sapiens
ctggaatctgaaggcaggagtcca

SEQ ID NO: 6249 - DNA, 24 bp, Homo sapiens
atatttcacaggcaggagtccaat

SEQ ID NO: 6250 - DNA, 24 bp, Homo sapiens
aatatttcacaggcaggagtccaa

SEQ ID NO: 6251 - DNA, 24 bp, Homo sapiens
aaatatttcacaggcaggagtcca

SEQ ID NO: 6252 - DNA, 24 bp, Homo sapiens
aaattggaaagagaatgggataga

SEQ ID NO: 6253 - DNA, 24 bp, Homo sapiens
aaaattggaaagagaatgggatag

SEQ ID NO: 6254 - DNA, 24 bp, Homo sapiens
aaaaattggaaagagaatgggata

SEQ ID NO: 6255 - DNA, 24 bp, Homo sapiens
tttaacaacaggagaaggagaagg

SEQ ID NO: 6256 - DNA, 24 bp, Homo sapiens
ttttaacaacaggagaaggagaag

SEQ ID NO: 6257 - DNA, 24 bp, Homo sapiens
attttaacaacaggagaaggagaa

SEQ ID NO: 6258 - DNA, 24 bp, Homo sapiens
ttttatttcagatgcgatctgtga

SEQ ID NO: 6259 - DNA, 24 bp, Homo sapiens
tttttatttcagatgcgatctgtg

SEQ ID NO: 6260 - DNA, 24 bp, Homo sapiens
atttttatttcagatgcgatctgt

SEQ ID NO: 6261 - DNA, 24 bp, Homo sapiens
tgataccacagaaagtatttattt

SEQ ID NO: 6262 - DNA, 24 bp, Homo sapiens
gtgataccacagaaagtatttatt

SEQ ID NO: 6263 - DNA, 24 bp, Homo sapiens
agtgataccacagaaagtatttat

SEQ ID NO: 6264 - DNA, 24 bp, Homo sapiens
ttgcagatgaggttgggctcagat

SEQ ID NO: 6265 - DNA, 24 bp, Homo sapiens
gttgcagatgaggttgggctcaga

SEQ ID NO: 6266 - DNA, 24 bp, Homo sapiens
agttgcagatgaggttgggctcag

SEQ ID NO: 6267 - DNA, 24 bp, Homo sapiens
ttcttttctagaacataccaaata

SEQ ID NO: 6268 - DNA, 24 bp, Homo sapiens
tttcttttctagaacataccaaat

SEQ ID NO: 6269 - DNA, 24 bp, Homo sapiens
ctttcttttctagaacataccaaa

SEQ ID NO: 6270 - DNA, 24 bp, Homo sapiens
tatatttaggggtaaggatctcat

SEQ ID NO: 6271 - DNA, 24 bp, Homo sapiens
ttatatttaggggtaaggatctca

SEQ ID NO: 6272 - DNA, 24 bp, Homo sapiens
tttatatttaggggtaaggatctc

SEQ ID NO: 6273 - DNA, 24 bp, Homo sapiens
ttattttccagggacttgcattgg

SEQ ID NO: 6274 - DNA, 24 bp, Homo sapiens
tttattttccagggacttgcattg

SEQ ID NO: 6275 - DNA, 24 bp, Homo sapiens
ttttattttccagggacttgcatt

SEQ ID NO: 6276 - DNA, 24 bp, Homo sapiens
aacttaagacaaacagaactgaaa

SEQ ID NO: 6277 - DNA, 24 bp, Homo sapiens
aaacttaagacaaacagaactgaa

SEQ ID NO: 6278 - DNA, 24 bp, Homo sapiens
aaaacttaagacaaacagaactga

SEQ ID NO: 6279 - DNA, 24 bp, Homo sapiens
acaaaatacaggatttcttacaaa

SEQ ID NO: 6280 - DNA, 24 bp, Homo sapiens
aacaaaatacaggatttcttacaa

SEQ ID NO: 6281 - DNA, 24 bp, Homo sapiens
aaacaaaatacaggatttcttaca

SEQ ID NO: 6282 - DNA, 24 bp, Homo sapiens
ttttttaacagggatttggggaat

SEQ ID NO: 6283 - DNA, 24 bp, Homo sapiens
tttttttaacagggatttggggaa

SEQ ID NO: 6284 - DNA, 24 bp, Homo sapiens
gtttttttaacagggatttgggga

SEQ ID NO: 6285 - DNA, 24 bp, Homo sapiens
tctgggaggaggtcagaattttta

SEQ ID NO: 6286 - DNA, 24 bp, Homo sapiens
ttctgggaggaggtcagaattttt

SEQ ID NO: 6287 - DNA, 24 bp, Homo sapiens
cttctgggaggaggtcagaatttt

SEQ ID NO: 6288 - DNA, 24 bp, Homo sapiens
gagcggcaggcacccagagtagta

SEQ ID NO: 6289 - DNA, 24 bp, Homo sapiens
ggaagcaaatgacatcacagcagg

SEQ ID NO: 6290 - DNA, 24 bp, Homo sapiens
gcattaggagcttgagcccagacg

SEQ ID NO: 6291 - DNA, 24 bp, Homo sapiens
ctttttttcagagaatgggataga

SEQ ID NO: 6292 - DNA, 24 bp, Homo sapiens
actttttttcagagaatgggatag

SEQ ID NO: 6293 - DNA, 24 bp, Homo sapiens
aactttttttcagagaatgggata

SEQ ID NO: 6294 - DNA, 24 bp, Homo sapiens
gcctctggaaaaggccagcgttgt

SEQ ID NO: 6295 - DNA, 24 bp, Homo sapiens
gaccccagcgcccgagagaccatg

SEQ ID NO: 6296 - DNA, 24 bp, Homo sapiens
gcattaggagcttgagcccagacg

SEQ ID NO: 6297 - DNA, 24 bp, Homo sapiens
aaattggaaaggaagtcaccaaag

SEQ ID NO: 6298 - DNA, 24 bp, Homo sapiens
aaaattggaaaggaagtcaccaaa

SEQ ID NO: 6299 - DNA, 24 bp, Homo sapiens
aaaaattggaaaggaagtcaccaa

SEQ ID NO: 6300 - DNA, 24 bp, Homo sapiens
agtgaaagacttgtgattacctca

SEQ ID NO: 6301 - DNA, 24 bp, Homo sapiens
tgaaaatatccaatctgttaaggc

SEQ ID NO: 6302 - DNA, 24 bp, Homo sapiens
ctgggaagaagcaatggaaaaaat

SEQ ID NO: 6303 - DNA, 24 bp, Homo sapiens
atgaagtacagaacagaactgaaa

SEQ ID NO: 6304 - DNA, 24 bp, Homo sapiens
gatgaagtacagaacagaactgaa

SEQ ID NO: 6305 - DNA, 24 bp, Homo sapiens
tgatgaagtacagaacagaactga

SEQ ID NO: 6306 - DNA, 24 bp, Homo sapiens
aacttaagacagatttcttacaaa

SEQ ID NO: 6307 - DNA, 24 bp, Homo sapiens
aaacttaagacagatttcttacaa

SEQ ID NO: 6308 - DNA, 24 bp, Homo sapiens
aaaacttaagacagatttcttaca

SEQ ID NO: 6309 - DNA, 24 bp, Homo sapiens
tggatacctagatgttttaacaga

SEQ ID NO: 6310 - DNA, 24 bp, Homo sapiens
tgatttgtatttattagactctcc

SEQ ID NO: 6311 - DNA, 24 bp, Homo sapiens
atatttgaaaggagtgcttttttg

SEQ ID NO: 6312 - DNA, 24 bp, Homo sapiens
aatatttgaaaggagtgctttttt

SEQ ID NO: 6313 - DNA, 24 bp, Homo sapiens
aaatatttgaaaggagtgcttttt

SEQ ID NO: 6314 - DNA, 24 bp, Homo sapiens
ggagagcataccagcagtgactac

SEQ ID NO: 6315 - DNA, 24 bp, Homo sapiens
ttggttgtgctgtggctccttgga

SEQ ID NO: 6316 - DNA, 24 bp, Homo sapiens
caccagcaccagttcgtattatgt

SEQ ID NO: 6317 - DNA, 24 bp, Homo sapiens
caccagcaccagttcgtattatgt

SEQ ID NO: 6318 - DNA, 24 bp, Homo sapiens
gccgacactttgcttgctatggga

SEQ ID NO: 6319 - DNA, 24 bp, Homo sapiens
ttggatgaccttctgcctcttacc

SEQ ID NO: 6320 - DNA, 24 bp, Homo sapiens
gttgaaagcagttgttattaattg

SEQ ID NO: 6321 - DNA, 24 bp, Homo sapiens
cgttgaaagcagttgttattaatt

SEQ ID NO: 6322 - DNA, 24 bp, Homo sapiens
acgttgaaagcagttgttattaat

SEQ ID NO: 6323 - DNA, 24 bp, Homo sapiens
gccgacactttgcttgctatggga

SEQ ID NO: 6324 - DNA, 24 bp, Homo sapiens
caccagcaccagttcgtattatgt

SEQ ID NO: 6325 - DNA, 24 bp, Homo sapiens
tggttgtgctgtggctccttggaa

SEQ ID NO: 6326 - DNA, 24 bp, Homo sapiens
ggaatctgaaggagaaggagaagg

SEQ ID NO: 6327 - DNA, 24 bp, Homo sapiens
tggaatctgaaggagaaggagaag

SEQ ID NO: 6328 - DNA, 24 bp, Homo sapiens
ctggaatctgaaggagaaggagaa

SEQ ID NO: 6329 - DNA, 24 bp, Homo sapiens
tatgaacagtggagtgatcaagaa

SEQ ID NO: 6330 - DNA, 24 bp, Homo sapiens
ggaacatttagaaaaaacttggat

SEQ ID NO: 6331 - DNA, 24 bp, Homo sapiens
gcaacagtggaggaaagcctttgg

SEQ ID NO: 6332 - DNA, 24 bp, Homo sapiens
cgatggtgtgtcttgggattcaat

SEQ ID NO: 6333 - DNA, 24 bp, Homo sapiens
tgggaagaactggatcagggaaga

SEQ ID NO: 6334 - DNA, 24 bp, Homo sapiens
ggcttctattggtggttgacacaa

SEQ ID NO: 6335 - DNA, 24 bp, Homo sapiens
gtcggcaagaatgaacctgtggat

SEQ ID NO: 6336 - DNA, 24 bp, Homo sapiens
cgccagtctatccgcacagttctt

SEQ ID NO: 6337 - DNA, 24 bp, Homo sapiens
cgccagtctatccgcacagttctt

SEQ ID NO: 6338 - DNA, 24 bp, Homo sapiens
gtcggcaagaatgaacctgtggat

SEQ ID NO: 6339 - DNA, 23 bp, Homo sapiens
gctggctcctcatcctgtctagg

SEQ ID NO: 6340 - DNA, 24 bp, Homo sapiens
cgccagtctatccgcacagttctt

SEQ ID NO: 6341 - DNA, 24 bp, Homo sapiens
ccaccttccactggttcctcctgg

SEQ ID NO: 6342 - DNA, 25 bp, Homo sapiens
acgctgatcgaggaagtcttgttct

SEQ ID NO: 6343 - DNA, 24 bp, Homo sapiens
cgccagtctatccgcacagttctt

SEQ ID NO: 6344 - DNA, 23 bp, Homo sapiens
gctggctcctcatcctgtctagg

SEQ ID NO: 6345 - DNA, 25 bp, Homo sapiens
cgaggaagtcttgttctactattca

SEQ ID NO: 6346 - DNA, 24 bp, Homo sapiens
aaggtcaacaggatgctgcagcca

SEQ ID NO: 6347 - DNA, 24 bp, Homo sapiens
gaaggtcaacaggatgctgcagcc

SEQ ID NO: 6348 - DNA, 24 bp, Homo sapiens
tgaaggtcaacaggatgctgcagc

SEQ ID NO: 6349 - DNA, 24 bp, Homo sapiens
ccacgacccaggtaaagacgccca

SEQ ID NO: 6350 - DNA, 24 bp, Homo sapiens
gccacgacccaggtaaagacgccc

SEQ ID NO: 6351 - DNA, 24 bp, Homo sapiens
ggccacgacccaggtaaagacgcc

SEQ ID NO: 6352 - DNA, 24 bp, Homo sapiens
caacttcaacagccagagacgcct

SEQ ID NO: 6353 - DNA, 25 bp, Homo sapiens
cgccgagttaaggtggatgttgaga

SEQ ID NO: 6354 - DNA, 25 bp, Homo sapiens
gcgagttcaaggagtggttctctaa

SEQ ID NO: 6355 - DNA, 24 bp, Homo sapiens
tccttctccagctcctcctctggc

SEQ ID NO: 6356 - DNA, 24 bp, Homo sapiens
ctccttctccagctcctcctctgg

SEQ ID NO: 6357 - DNA, 24 bp, Homo sapiens
gctccttctccagctcctcctctg

SEQ ID NO: 6358 - DNA, 23 bp, Homo sapiens
gaaccttctagctcatccgtgcc

SEQ ID NO: 6359 - DNA, 24 bp, Homo sapiens
ctgaagaggaggaagagactgtgg

SEQ ID NO: 6360 - DNA, 23 bp, Homo sapiens
agcagactcatattctggagcag

SEQ ID NO: 6361 - DNA, 25 bp, Homo sapiens
tgagtctgaagagtctgaggatgcc

SEQ ID NO: 6362 - DNA, 25 bp, Homo sapiens
agagccaagcagatgaagaggagga

SEQ ID NO: 6363 - DNA, 25 bp, Homo sapiens
ggatgaagagcagagtgaggcagat

SEQ ID NO: 6364 - DNA, 23 bp, Homo sapiens
cccaggtaaagacgcccattccc

SEQ ID NO: 6365 - DNA, 25 bp, Homo sapiens
ggatgaagagcagagtgaggcagat

SEQ ID NO: 6366 - DNA, 25 bp, Homo sapiens
agagccaagcagatgaagaggagga

SEQ ID NO: 6367 - DNA, 25 bp, Homo sapiens
cgccgagttaaggtggatgttgaga

SEQ ID NO: 6368 - DNA, 24 bp, Homo sapiens
aagtacgagcatgttatccgctgc

SEQ ID NO: 6369 - DNA, 23 bp, Homo sapiens
cgtcaacgctgtctctatgatga

SEQ ID NO: 6370 - DNA, 25 bp, Homo sapiens
gcaatcatccaaatctgttcgaccc

SEQ ID NO: 6371 - DNA, 25 bp, Homo sapiens
gttacctcccctttcatcaccccag

SEQ ID NO: 6372 - DNA, 23 bp, Homo sapiens
accgcctctctggtgctaagggc

SEQ ID NO: 6373 - DNA, 25 bp, Homo sapiens
ttagaagtggctactgctcctgacc

SEQ ID NO: 6374 - DNA, 25 bp, Homo sapiens
ggcacagaccacaactaaggagaca

SEQ ID NO: 6375 - DNA, 24 bp, Homo sapiens
aagtacgagcatgttatccgctgc

SEQ ID NO: 6376 - DNA, 25 bp, Homo sapiens
gcaaacctctcaccttccaaatcca

SEQ ID NO: 6377 - DNA, 25 bp, Homo sapiens
aggcgtggtgaagattgtagtgaga

SEQ ID NO: 6378 - DNA, 25 bp, Homo sapiens
gactgactcctgttcctccattggc

SEQ ID NO: 6379 - DNA, 25 bp, Homo sapiens
aggcgtggtgaagattgtagtgaga

SEQ ID NO: 6380 - DNA, 25 bp, Homo sapiens
gactgactcctgttcctccattggc

SEQ ID NO: 6381 - DNA, 23 bp, Homo sapiens
gcctcttctcaagctggtccaca

SEQ ID NO: 6382 - DNA, 23 bp, Homo sapiens
gctcctcctctggctcctcttcc

SEQ ID NO: 6383 - DNA, 23 bp, Homo sapiens
gctgctcctgtcctggcttcatc

SEQ ID NO: 6384 - DNA, 25 bp, Homo sapiens
aggctcatctccatctcagacactc

SEQ ID NO: 6385 - DNA, 23 bp, Homo sapiens
atgttggctaggctggtcacgag

SEQ ID NO: 6386 - DNA, 23 bp, Homo sapiens
ccagatcctcctgcctcagcctc

SEQ ID NO: 6387 - DNA, 23 bp, Homo sapiens
gccctcctcagcctcccaaagtg

SEQ ID NO: 6388 - DNA, 24 bp, Homo sapiens
atgcctcccagggtcaccttccag

SEQ ID NO: 6389 - DNA, 24 bp, Homo sapiens
gatgcctcccagggtcaccttcca

SEQ ID NO: 6390 - DNA, 24 bp, Homo sapiens
agatgcctcccagggtcaccttcc

SEQ ID NO: 6391 - DNA, 24 bp, Homo sapiens
accatccatgagatccactgtcaa

SEQ ID NO: 6392 - DNA, 25 bp, Homo sapiens
aacaagaagttggagaagaggctgt

SEQ ID NO: 6393 - DNA, 23 bp, Homo sapiens
gaggagactgagtgccctttgcg

SEQ ID NO: 6394 - DNA, 25 bp, Homo sapiens
atgtaacaagaagttggagaagagg

SEQ ID NO: 6395 - DNA, 25 bp, Homo sapiens
ctgacatggagactcacatggctgc

SEQ ID NO: 6396 - DNA, 24 bp, Homo sapiens
accatccatgagatccactgtcaa

SEQ ID NO: 6397 - DNA, 24 bp, Homo sapiens
ccagcctcaagagacctcaccaga

SEQ ID NO: 6398 - DNA, 25 bp, Homo sapiens
cctgtcttctggttacctggatgat

SEQ ID NO: 6399 - DNA, 24 bp, Homo sapiens
cctcccagccgacccattaacaat

SEQ ID NO: 6400 - DNA, 24 bp, Homo sapiens
aagcctacggtctccagagttgtt

SEQ ID NO: 6401 - DNA, 24 bp, Homo sapiens
tgccacacaaccagccatttctcc

SEQ ID NO: 6402 - DNA, 25 bp, Homo sapiens
cagcagcatctgtgaccaacataca

SEQ ID NO: 6403 - DNA, 25 bp, Homo sapiens
agtgctacgaagaccagtccattga

SEQ ID NO: 6404 - DNA, 25 bp, Homo sapiens
ctctcaatgacagcagcctcgactt

SEQ ID NO: 6405 - DNA, 25 bp, Homo sapiens
acgatgtgggtgattgggttagtgt

SEQ ID NO: 6406 - DNA, 25 bp, Homo sapiens
gcccctgtaacttataccccaccca

SEQ ID NO: 6407 - DNA, 23 bp, Homo sapiens
gccgctccagctccaactcctcc

SEQ ID NO: 6408 - DNA, 23 bp, Homo sapiens
cccacggatgaggagaaggtccc

SEQ ID NO: 6409 - DNA, 25 bp, Homo sapiens
tgcccaggctggtcttaaactttga

SEQ ID NO: 6410 - DNA, 23 bp, Homo sapiens
gtccaccctcctcggcctcctaa

SEQ ID NO: 6411 - DNA, 25 bp, Homo sapiens
aagacctcgtcccttcctagtcagg

SEQ ID NO: 6412 - DNA, 24 bp, Homo sapiens
gtttcctggattgtaccgcactgg

SEQ ID NO: 6413 - DNA, 23 bp, Homo sapiens
gcatgactgagtgcttcctgccc

SEQ ID NO: 6414 - DNA, 25 bp, Homo sapiens
aagacctcgtcccttcctagtcagg

SEQ ID NO: 6415 - DNA, 25 bp, Homo sapiens
gacaggagtgtgaaaccaagattgc

SEQ ID NO: 6416 - DNA, 25 bp, Homo sapiens
gcagggtgggataaaggatttgtct

SEQ ID NO: 6417 - DNA, 25 bp, Homo sapiens
ggcatcaaggaggagatcaggagac

SEQ ID NO: 6418 - DNA, 25 bp, Homo sapiens
aggttgccataaaggacaaacaagt

SEQ ID NO: 6419 - DNA, 23 bp, Homo sapiens
attccaggagggtgagcgagtgc

SEQ ID NO: 6420 - DNA, 24 bp, Homo sapiens
aggaggaggcggcgaatcacttat

SEQ ID NO: 6421 - DNA, 23 bp, Homo sapiens
cctccgcctcccaagttgaagca

SEQ ID NO: 6422 - DNA, 25 bp, Homo sapiens
cagatggagtcttgctctcttgccc

SEQ ID NO: 6423 - DNA, 25 bp, Homo sapiens
gcaatggtgtgatttccactcgctg

SEQ ID NO: 6424 - DNA, 24 bp, Homo sapiens
agactgaagtgaaagaagaaccag

SEQ ID NO: 6425 - DNA, 24 bp, Homo sapiens
aagactgaagtgaaagaagaacca

SEQ ID NO: 6426 - DNA, 24 bp, Homo sapiens
aaagactgaagtgaaagaagaacc

SEQ ID NO: 6427 - DNA, 25 bp, Homo sapiens
tcacctattcctctgactcctagca

SEQ ID NO: 6428 - DNA, 23 bp, Homo sapiens
cagcaggacacatccgccagcat

SEQ ID NO: 6429 - DNA, 24 bp, Homo sapiens
tgagccagaagcattgcagtctct

SEQ ID NO: 6430 - DNA, 23 bp, Homo sapiens
ggaggctgaagcaggagaatggc

SEQ ID NO: 6431 - DNA, 23 bp, Homo sapiens
gtggcgggtgcctgtagtcccag

SEQ ID NO: 6432 - DNA, 25 bp, Homo sapiens
catctctattgaaaaagtacaaaaa

SEQ ID NO: 6433 - DNA, 24 bp, Homo sapiens
caaaaattcaggaacaccagcctc

SEQ ID NO: 6434 - DNA, 24 bp, Homo sapiens
ccaaaaattcaggaacaccagcct

SEQ ID NO: 6435 - DNA, 24 bp, Homo sapiens
cccaaaaattcaggaacaccagcc

SEQ ID NO: 6436 - DNA, 25 bp, Homo sapiens
aattgattcttctgcctcagcctcc

SEQ ID NO: 6437 - DNA, 23 bp, Homo sapiens
gctcactgcaaactccacctccc

SEQ ID NO: 6438 - DNA, 23 bp, Homo sapiens
ccaggctggagtgcaatggcatg

SEQ ID NO: 6439 - DNA, 24 bp, Homo sapiens
agatgatgaagatggagatggcga

SEQ ID NO: 6440 - DNA, 24 bp, Homo sapiens
aagatgatgaagatggagatggcg

SEQ ID NO: 6441 - DNA, 24 bp, Homo sapiens
gaagatgatgaagatggagatggc

SEQ ID NO: 6442 - DNA, 25 bp, Homo sapiens
tcaaacagaccctccctcagttcca

SEQ ID NO: 6443 - DNA, 25 bp, Homo sapiens
tgcgaatacccacccacacaagatg

SEQ ID NO: 6444 - DNA, 25 bp, Homo sapiens
gcattagatcaggcaagtgaagaga

SEQ ID NO: 6445 - DNA, 24 bp, Homo sapiens
tggtcaaaaaggtccaagcagctc

SEQ ID NO: 6446 - DNA, 24 bp, Homo sapiens
gtggtcaaaaaggtccaagcagct

SEQ ID NO: 6447 - DNA, 24 bp, Homo sapiens
tgtggtcaaaaaggtccaagcagc

SEQ ID NO: 6448 - DNA, 24 bp, Homo sapiens
gtcggtcccagcccctgcagttca

SEQ ID NO: 6449 - DNA, 24 bp, Homo sapiens
tgtcggtcccagcccctgcagttc

SEQ ID NO: 6450 - DNA, 24 bp, Homo sapiens
ctgtcggtcccagcccctgcagtt

SEQ ID NO: 6451 - DNA, 24 bp, Homo sapiens
gctctgcctcgggcccctccccaa

SEQ ID NO: 6452 - DNA, 24 bp, Homo sapiens
tgctctgcctcgggcccctcccca

SEQ ID NO: 6453 - DNA, 24 bp, Homo sapiens
ctgctctgcctcgggcccctcccc

SEQ ID NO: 6454 - DNA, 23 bp, Homo sapiens
ggtaataaacccggacggaagcg

SEQ ID NO: 6455 - DNA, 24 bp, Homo sapiens
atggaaggaagccttttggccata

SEQ ID NO: 6456 - DNA, 24 bp, Homo sapiens
tatggaaggaagccttttggccat

SEQ ID NO: 6457 - DNA, 24 bp, Homo sapiens
ttatggaaggaagccttttggcca

SEQ ID NO: 6458 - DNA, 24 bp, Homo sapiens
gacagacccaggtaggttggtgat

SEQ ID NO: 6459 - DNA, 24 bp, Homo sapiens
agacagacccaggtaggttggtga

SEQ ID NO: 6460 - DNA, 24 bp, Homo sapiens
cagacagacccaggtaggttggtg

SEQ ID NO: 6461 - DNA, 24 bp, Homo sapiens
acgacggcaggaattattggaggc

SEQ ID NO: 6462 - DNA, 24 bp, Homo sapiens
aatgatggaagaattgcatagcct

SEQ ID NO: 6463 - DNA, 24 bp, Homo sapiens
acgacggcaggaattattggaggc

SEQ ID NO: 6464 - DNA, 24 bp, Homo sapiens
gcagattactgaggaagacttaga

SEQ ID NO: 6465 - DNA, 24 bp, Homo sapiens
ggcagattactgaggaagacttag

SEQ ID NO: 6466 - DNA, 24 bp, Homo sapiens
cggcagattactgaggaagactta

SEQ ID NO: 6467 - DNA, 24 bp, Homo sapiens
cctctccgtgggtaagctggtcac

SEQ ID NO: 6468 - DNA, 24 bp, Homo sapiens
tcctctccgtgggtaagctggtca

SEQ ID NO: 6469 - DNA, 24 bp, Homo sapiens
ctcctctccgtgggtaagctggtc

SEQ ID NO: 6470 - DNA, 24 bp, Homo sapiens
ccacttctcctgcactgacgacgt

SEQ ID NO: 6471 - DNA, 24 bp, Homo sapiens
gggtcagtccgtgatcctcccgca

SEQ ID NO: 6472 - DNA, 24 bp, Homo sapiens
ctgctttgccacgcccgccgtcac

SEQ ID NO: 6473 - DNA, 24 bp, Homo sapiens
gcctgcgaggagtcacattaactt

SEQ ID NO: 6474 - DNA, 24 bp, Homo sapiens
gctgagaattgatgtccgctcttc

SEQ ID NO: 6475 - DNA, 24 bp, Homo sapiens
cctgaccgtgcagtaaccgctacc

SEQ ID NO: 6476 - DNA, 24 bp, Homo sapiens
gccaggcatggacagcaggatcaa

SEQ ID NO: 6477 - DNA, 24 bp, Homo sapiens
cgccaggcatggacagcaggatca

SEQ ID NO: 6478 - DNA, 24 bp, Homo sapiens
tcgccaggcatggacagcaggatc

SEQ ID NO: 6479 - DNA, 25 bp, Homo sapiens
caggcatggacagcaggatcaagat

SEQ ID NO: 6480 - DNA, 23 bp, Homo sapiens
ggagcagacgcagaaccgagagc

SEQ ID NO: 6481 - DNA, 25 bp, Homo sapiens
acgcccagtgtttaccagttcagtc

SEQ ID NO: 6482 - DNA, 23 bp, Homo sapiens
ggagcagacgcagaaccgagagc

SEQ ID NO: 6483 - DNA, 25 bp, Homo sapiens
acgcccagtgtttaccagttcagtc

SEQ ID NO: 6484 - DNA, 24 bp, Homo sapiens
caaacctcagcccaccacttccag

SEQ ID NO: 6485 - DNA, 25 bp, Homo sapiens
acgcccagtgtttaccagttcagtc

SEQ ID NO: 6486 - DNA, 24 bp, Homo sapiens
caaacctcagcccaccacttccag

SEQ ID NO: 6487 - DNA, 25 bp, Homo sapiens
gctggtgtagaaggaactgcgtctt

SEQ ID NO: 6488 - DNA, 24 bp, Homo sapiens
gagaaaaggagctactggtgctac

SEQ ID NO: 6489 - DNA, 24 bp, Homo sapiens
ggagaaaaggagctactggtgcta

SEQ ID NO: 6490 - DNA, 24 bp, Homo sapiens
gggagaaaaggagctactggtgct

SEQ ID NO: 6491 - DNA, 24 bp, Homo sapiens
gaatcaggcagtcagtcagagtct

SEQ ID NO: 6492 - DNA, 24 bp, Homo sapiens
agcagtagccagtcaggtagcagt

SEQ ID NO: 6493 - DNA, 24 bp, Homo sapiens
gcttcaggctctggatctggttcg

SEQ ID NO: 6494 - DNA, 24 bp, Homo sapiens
tcgtcgccaagcaactgttaatgt

SEQ ID NO: 6495 - DNA, 24 bp, Homo sapiens
actggaagtctgtggagaggatgt

SEQ ID NO: 6496 - DNA, 24 bp, Homo sapiens
ggaggatgaagaaatgaaaacaga

SEQ ID NO: 6497 - DNA, 24 bp, Homo sapiens
ctcagcaaaggttccaagggcagt

SEQ ID NO: 6498 - DNA, 24 bp, Homo sapiens
tgttgtaaccattgctacctcatt

SEQ ID NO: 6499 - DNA, 24 bp, Homo sapiens
ggtgcggatgttagatatacttgc

SEQ ID NO: 6500 - DNA, 24 bp, Homo sapiens
ttgttttttagctggacagactcc

SEQ ID NO: 6501 - DNA, 24 bp, Homo sapiens
tttgttttttagctggacagactc

SEQ ID NO: 6502 - DNA, 24 bp, Homo sapiens
ctttgttttttagctggacagact

SEQ ID NO: 6503 - DNA, 24 bp, Homo sapiens
tgccagtgctggtgattatgggag

SEQ ID NO: 6504 - DNA, 24 bp, Homo sapiens
atgccagtgctggtgattatggga

SEQ ID NO: 6505 - DNA, 24 bp, Homo sapiens
gatgccagtgctggtgattatggg

SEQ ID NO: 6506 - DNA, 24 bp, Homo sapiens
tgccagtgctggtttgtgtatttc

SEQ ID NO: 6507 - DNA, 24 bp, Homo sapiens
atgccagtgctggtttgtgtattt

SEQ ID NO: 6508 - DNA, 24 bp, Homo sapiens
gatgccagtgctggtttgtgtatt

SEQ ID NO: 6509 - DNA, 23 bp, Homo sapiens
ctggtcaggttctgcctcctcct

SEQ ID NO: 6510 - DNA, 23 bp, Homo sapiens
atcgccctccaccaccagttctt

SEQ ID NO: 6511 - DNA, 23 bp, Homo sapiens
tccacctccagttccaggctacg

SEQ ID NO: 6512 - DNA, 25 bp, Homo sapiens
tggtcagaatcctgttgtaactcca

SEQ ID NO: 6513 - DNA, 23 bp, Homo sapiens
cgtccacccttaggtcctccagg

SEQ ID NO: 6514 - DNA, 23 bp, Homo sapiens
ctggtcaggttctgcctcctcct

SEQ ID NO: 6515 - DNA, 23 bp, Homo sapiens
ctggtcaggttctgcctcctcct

SEQ ID NO: 6516 - DNA, 23 bp, Homo sapiens
atcgccctccaccaccagttctt

SEQ ID NO: 6517 - DNA, 23 bp, Homo sapiens
gcagcctccattgggtccacttc

SEQ ID NO: 6518 - DNA, 24 bp, Homo sapiens
agtgctggtgattatgggagtgct

SEQ ID NO: 6519 - DNA, 23 bp, Homo sapiens
gcaagaacgccattgagtgaagc

SEQ ID NO: 6520 - DNA, 25 bp, Homo sapiens
acatcagatagccgaggtccaccac

SEQ ID NO: 6521 - DNA, 24 bp, Homo sapiens
gatctcctgacctcgtgattcacc

SEQ ID NO: 6522 - DNA, 25 bp, Homo sapiens
caaagtgctgggattacagatgtga

SEQ ID NO: 6523 - DNA, 24 bp, Homo sapiens
cctggcacagggtaagcacaatag

SEQ ID NO: 6524 - DNA, 24 bp, Homo sapiens
acctggcacagggtaagcacaata

SEQ ID NO: 6525 - DNA, 24 bp, Homo sapiens
tacctggcacagggtaagcacaat

SEQ ID NO: 6526 - DNA, 25 bp, Homo sapiens
ggaattgccaatcacagcgagaagc

SEQ ID NO: 6527 - DNA, 23 bp, Homo sapiens
ggtgccctgcccaacattgaatt

SEQ ID NO: 6528 - DNA, 23 bp, Homo sapiens
tccgcactttcgttgactacgcc

SEQ ID NO: 6529 - DNA, 24 bp, Homo sapiens
ttgtttcctaggatgatggcttgg

SEQ ID NO: 6530 - DNA, 24 bp, Homo sapiens
tttgtttcctaggatgatggcttg

SEQ ID NO: 6531 - DNA, 24 bp, Homo sapiens
ttttgtttcctaggatgatggctt

SEQ ID NO: 6532 - DNA, 24 bp, Homo sapiens
aaagaaaggagccactggagcatc

SEQ ID NO: 6533 - DNA, 24 bp, Homo sapiens
gaaagaaaggagccactggagcat

SEQ ID NO: 6534 - DNA, 24 bp, Homo sapiens
ggaaagaaaggagccactggagca

SEQ ID NO: 6535 - DNA, 24 bp, Homo sapiens
gctccctgcctttgcctcacttta

SEQ ID NO: 6536 - DNA, 24 bp, Homo sapiens
gccttgttggaaagaagcagccgt

SEQ ID NO: 6537 - DNA, 24 bp, Homo sapiens
gaaggaggctctagatggcggctg

SEQ ID NO: 6538 - DNA, 24 bp, Homo sapiens
gaaaaactcagtcactcagcctct

SEQ ID NO: 6539 - DNA, 24 bp, Homo sapiens
agaaaaactcagtcactcagcctc

SEQ ID NO: 6540 - DNA, 24 bp, Homo sapiens
gagaaaaactcagtcactcagcct

SEQ ID NO: 6541 - DNA, 24 bp, Homo sapiens
aagcagccgaagactcagcgtgga

SEQ ID NO: 6542 - DNA, 24 bp, Homo sapiens
gcaagattcttctgatgaggatga

SEQ ID NO: 6543 - DNA, 24 bp, Homo sapiens
tgacgaagctcccaaaaggcagac

SEQ ID NO: 6544 - DNA, 24 bp, Homo sapiens
ccaaccataggctcctgattacgg

SEQ ID NO: 6545 - DNA, 24 bp, Homo sapiens
gagtcttcataaggtgctagagcc

SEQ ID NO: 6546 - DNA, 24 bp, Homo sapiens
ggtggagatgtcagcccttcagaa

SEQ ID NO: 6547 - DNA, 24 bp, Homo sapiens
ccaaccataggctcctgattacgg

SEQ ID NO: 6548 - DNA, 24 bp, Homo sapiens
ggtggagatgtcagcccttcagaa

SEQ ID NO: 6549 - DNA, 24 bp, Homo sapiens
tctgaccaggaattacaaggctct

SEQ ID NO: 6550 - DNA, 24 bp, Homo sapiens
gagtcttcataaggtgctagagcc

SEQ ID NO: 6551 - DNA, 24 bp, Homo sapiens
ggtggagatgtcagcccttcagaa

SEQ ID NO: 6552 - DNA, 24 bp, Homo sapiens
tctgaccaggaattacaaggctct

SEQ ID NO: 6553 - DNA, 24 bp, Homo sapiens
cattggagaggatgaggatgatga

SEQ ID NO: 6554 - DNA, 24 bp, Homo sapiens
ccatattacagcaggaagtgaacc

SEQ ID NO: 6555 - DNA, 24 bp, Homo sapiens
cgagtaaatcaaagcgatctcagg

SEQ ID NO: 6556 - DNA, 24 bp, Homo sapiens
ttgtgcctcctcctggatacatga

SEQ ID NO: 6557 - DNA, 25 bp, Homo sapiens
ctgtgcttcctgatggttctcctgt

SEQ ID NO: 6558 - DNA, 25 bp, Homo sapiens
ccaaacaatagccgacctctcaccc

SEQ ID NO: 6559 - DNA, 24 bp, Homo sapiens
ggctgaggcaggagaatcacttga

SEQ ID NO: 6560 - DNA, 24 bp, Homo sapiens
aggctgaggcaggagaatcacttg

SEQ ID NO: 6561 - DNA, 24 bp, Homo sapiens
gaggctgaggcaggagaatcactt

SEQ ID NO: 6562 - DNA, 23 bp, Homo sapiens
gcactttgggaggctgaggcagg

SEQ ID NO: 6563 - DNA, 24 bp, Homo sapiens
cacctgtcccacctgctgaagatg

SEQ ID NO: 6564 - DNA, 24 bp, Homo sapiens
cctgaactggctgaggtggaggaa

SEQ ID NO: 6565 - DNA, 24 bp, Homo sapiens
tgattcgcaagaaggttcaggagt

SEQ ID NO: 6566 - DNA, 25 bp, Homo sapiens
ctcagtcactacaacctctgcctcc

SEQ ID NO: 6567 - DNA, 23 bp, Homo sapiens
tggcacgatcttggctcactgaa

SEQ ID NO: 6568 - DNA, 23 bp, Homo sapiens
gcgattatcctgcttcagcctcc

SEQ ID NO: 6569 - DNA, 25 bp, Homo sapiens
gcgtgccttggacttggtattctac

SEQ ID NO: 6570 - DNA, 23 bp, Homo sapiens
cacctagaacactgtcctgaccg

SEQ ID NO: 6571 - DNA, 23 bp, Homo sapiens
atgtccgattcacacgctacaca

SEQ ID NO: 6572 - DNA, 24 bp, Homo sapiens
gccctccacagccgagttacagcc

SEQ ID NO: 6573 - DNA, 24 bp, Homo sapiens
agccctccacagccgagttacagc

SEQ ID NO: 6574 - DNA, 24 bp, Homo sapiens
cagccctccacagccgagttacag

SEQ ID NO: 6575 - DNA, 24 bp, Homo sapiens
tattgacacctataactgcgacct

SEQ ID NO: 6576 - DNA, 24 bp, Homo sapiens
ctattgacacctataactgcgacc

SEQ ID NO: 6577 - DNA, 24 bp, Homo sapiens
gctattgacacctataactgcgac

SEQ ID NO: 6578 - DNA, 25 bp, Homo sapiens
gccagcacctacaataagaacagca

SEQ ID NO: 6579 - DNA, 23 bp, Homo sapiens
cacagcagcctccgccaccacag

SEQ ID NO: 6580 - DNA, 25 bp, Homo sapiens
caacaactccaacaacagaggcagc

SEQ ID NO: 6581 - DNA, 24 bp, Homo sapiens
tgcagcgggaggaagcggacaagc

SEQ ID NO: 6582 - DNA, 24 bp, Homo sapiens
ctgcagcgggaggaagcggacaag

SEQ ID NO: 6583 - DNA, 24 bp, Homo sapiens
gctgcagcgggaggaagcggacaa

SEQ ID NO: 6584 - DNA, 23 bp, Homo sapiens
cgcagcggaggtggtggctatag

SEQ ID NO: 6585 - DNA, 23 bp, Homo sapiens
ccgctggggtaacaacaaccggg

SEQ ID NO: 6586 - DNA, 23 bp, Homo sapiens
acaactccaacaacagaggcagc

SEQ ID NO: 6587 - DNA, 23 bp, Homo sapiens
accacccagctacagccctgctc

SEQ ID NO: 6588 - DNA, 23 bp, Homo sapiens
agcaacatccctggctcaagcgc

SEQ ID NO: 6589 - DNA, 23 bp, Homo sapiens
ccccaggggccagcacctacaat

SEQ ID NO: 6590 - DNA, 24 bp, Homo sapiens
agcacccccaccgtcagcagctac

SEQ ID NO: 6591 - DNA, 24 bp, Homo sapiens
cagcacccccaccgtcagcagcta

SEQ ID NO: 6592 - DNA, 24 bp, Homo sapiens
ccagcacccccaccgtcagcagct

SEQ ID NO: 6593 - DNA, 25 bp, Homo sapiens
gccagcacctacaataagaacagca

SEQ ID NO: 6594 - DNA, 23 bp, Homo sapiens
tccacagccgagttacagccagc

SEQ ID NO: 6595 - DNA, 23 bp, Homo sapiens
accagggaggttacagccagggc

SEQ ID NO: 6596 - DNA, 24 bp, Homo sapiens
cctacaataagaacagcaacatcc

SEQ ID NO: 6597 - DNA, 23 bp, Homo sapiens
cagcagccaccgccaccacccag

SEQ ID NO: 6598 - DNA, 23 bp, Homo sapiens
ccctgctcggaaccccccagggg

SEQ ID NO: 6599 - DNA, 23 bp, Homo sapiens
aaccgggctccccagcaacagcc

SEQ ID NO: 6600 - DNA, 24 bp, Homo sapiens
cgcagtggagttcaacttcggaca

SEQ ID NO: 6601 - DNA, 23 bp, Homo sapiens
agccctactgttctgtcctcccg

SEQ ID NO: 6602 - DNA, 24 bp, Homo sapiens
cctctatcctcatgtcctggtgaa

SEQ ID NO: 6603 - DNA, 24 bp, Homo sapiens
ccctgccccaggcctcccagtggc

SEQ ID NO: 6604 - DNA, 24 bp, Homo sapiens
tccctgccccaggcctcccagtgg

SEQ ID NO: 6605 - DNA, 24 bp, Homo sapiens
atccctgccccaggcctcccagtg

SEQ ID NO: 6606 - DNA, 24 bp, Homo sapiens
ggttcaagcgattctcctgcctca

SEQ ID NO: 6607 - DNA, 24 bp, Homo sapiens
ggctgatctggaactcctgacctc

SEQ ID NO: 6608 - DNA, 24 bp, Homo sapiens
caggctggagtacaatggcatgat

SEQ ID NO: 6609 - DNA, 25 bp, Homo sapiens
agagcgaagatgcgatgcctgttat

SEQ ID NO: 6610 - DNA, 23 bp, Homo sapiens
gacaagtcctatctcctgccgcc

SEQ ID NO: 6611 - DNA, 23 bp, Homo sapiens
aacctgaagcggcagcaagagcg

SEQ ID NO: 6612 - DNA, 23 bp, Homo sapiens
tgattctcctgccacagcttcct

SEQ ID NO: 6613 - DNA, 23 bp, Homo sapiens
ggctggagtgccgtgatgtgatc

SEQ ID NO: 6614 - DNA, 23 bp, Homo sapiens
cactgcaacctctgcctccaagg

SEQ ID NO: 6615 - DNA, 25 bp, Homo sapiens
cggcgattcaaagttagtcaggtaa

SEQ ID NO: 6616 - DNA, 24 bp, Homo sapiens
caggtaatcatggaaaagtctaca

SEQ ID NO: 6617 - DNA, 24 bp, Homo sapiens
tcaggtaatcatggaaaagtctac

SEQ ID NO: 6618 - DNA, 24 bp, Homo sapiens
gtcaggtaatcatggaaaagtcta

SEQ ID NO: 6619 - DNA, 25 bp, Homo sapiens
cagaaaaacaagtagaaactgagga

SEQ ID NO: 6620 - DNA, 25 bp, Homo sapiens
ggcaggagtagtgacaacagcaaca

SEQ ID NO: 6621 - DNA, 25 bp, Homo sapiens
tgcagctacagaagtcaagattcca

SEQ ID NO: 6622 - DNA, 25 bp, Homo sapiens
agtgacatcattactgaagaggaca

SEQ ID NO: 6623 - DNA, 24 bp, Homo sapiens
ccaccctggccgacagcctccttc

SEQ ID NO: 6624 - DNA, 24 bp, Homo sapiens
cccaccctggccgacagcctcctt

SEQ ID NO: 6625 - DNA, 24 bp, Homo sapiens
gcccaccctggccgacagcctcct

SEQ ID NO: 6626 - DNA, 24 bp, Homo sapiens
tttgtctttgggaaaccacaggaa

SEQ ID NO: 6627 - DNA, 24 bp, Homo sapiens
ttttgtctttgggaaaccacagga

SEQ ID NO: 6628 - DNA, 24 bp, Homo sapiens
tttttgtctttgggaaaccacagg

SEQ ID NO: 6629 - DNA, 25 bp, Homo sapiens
gcaagaagaagatgaggcagaaggt

SEQ ID NO: 6630 - DNA, 25 bp, Homo sapiens
gctattgaacaagacagacaaccgc

SEQ ID NO: 6631 - DNA, 25 bp, Homo sapiens
cgaggattcaggcaattactggcaa

SEQ ID NO: 6632 - DNA, 23 bp, Homo sapiens
actcctccagcacctcacacctc

SEQ ID NO: 6633 - DNA, 25 bp, Homo sapiens
gcctacgactgtctctggaactact

SEQ ID NO: 6634 - DNA, 23 bp, Homo sapiens
caatcctggcagcaacctcaagg

SEQ ID NO: 6635 - DNA, 25 bp, Homo sapiens
ttgttccagcctcttcagactgtgc

SEQ ID NO: 6636 - DNA, 24 bp, Homo sapiens
ggaactccctctcttctcggtagc

SEQ ID NO: 6637 - DNA, 25 bp, Homo sapiens
acgggagagtggtagaactggatca

SEQ ID NO: 6638 - DNA, 24 bp, Homo sapiens
gagccatcaaggttacagatcgac

SEQ ID NO: 6639 - DNA, 24 bp, Homo sapiens
ggagccatcaaggttacagatcga

SEQ ID NO: 6640 - DNA, 24 bp, Homo sapiens
aggagccatcaaggttacagatcg

SEQ ID NO: 6641 - DNA, 25 bp, Homo sapiens
atgaagatgcagaccccacaaaatc

SEQ ID NO: 6642 - DNA, 23 bp, Homo sapiens
tgcagttgcatctttggcagctg

SEQ ID NO: 6643 - DNA, 25 bp, Homo sapiens
ctctctgtggaaagctactgaccct

SEQ ID NO: 6644 - DNA, 25 bp, Homo sapiens
aactagggattttattgaagattat

SEQ ID NO: 6645 - DNA, 25 bp, Homo sapiens
tcaagtgattctcctgcctcagcct

SEQ ID NO: 6646 - DNA, 23 bp, Homo sapiens
agtggcacggtctcggctccctg

SEQ ID NO: 6647 - DNA, 24 bp, Homo sapiens
ctacgcccttggcctcctgctgcc

SEQ ID NO: 6648 - DNA, 24 bp, Homo sapiens
tctacgcccttggcctcctgctgc

SEQ ID NO: 6649 - DNA, 24 bp, Homo sapiens
ctctacgcccttggcctcctgctg

SEQ ID NO: 6650 - DNA, 24 bp, Homo sapiens
ctcgcccccaggcctcctgctgcc

SEQ ID NO: 6651 - DNA, 24 bp, Homo sapiens
cctcgcccccaggcctcctgctgc

SEQ ID NO: 6652 - DNA, 24 bp, Homo sapiens
ccctcgcccccaggcctcctgctg

SEQ ID NO: 6653 - DNA, 24 bp, Homo sapiens
gagatgaaatgggattgtcatcag

SEQ ID NO: 6654 - DNA, 24 bp, Homo sapiens
cgagatgaaatgggattgtcatca

SEQ ID NO: 6655 - DNA, 24 bp, Homo sapiens
acgagatgaaatgggattgtcatc

SEQ ID NO: 6656 - DNA, 25 bp, Homo sapiens
accaactgctgaaagacttctgact

SEQ ID NO: 6657 - DNA, 24 bp, Homo sapiens
aaccacgcacattacactgaagca

SEQ ID NO: 6658 - DNA, 25 bp, Homo sapiens
ccatgcaatcattcgtcataccatt

SEQ ID NO: 6659 - DNA, 25 bp, Homo sapiens
tgtgcaacatcctggatacatcctg

SEQ ID NO: 6660 - DNA, 25 bp, Homo sapiens
gctacatgaggcaacgatggaacag

SEQ ID NO: 6661 - DNA, 25 bp, Homo sapiens
acggaagtgtacttggctgtatgtt

SEQ ID NO: 6662 - DNA, 23 bp, Homo sapiens
gctgccttccacaacttcatcaa

SEQ ID NO: 6663 - DNA, 23 bp, Homo sapiens
gagtcccaagaaacgacccagcg

SEQ ID NO: 6664 - DNA, 24 bp, Homo sapiens
ggacattgaggatgaggagcccga

SEQ ID NO: 6665 - DNA, 23 bp, Homo sapiens
atcagatccacccaccgctccag

SEQ ID NO: 6666 - DNA, 24 bp, Homo sapiens
ggacattgaggatgaggagcccga

SEQ ID NO: 6667 - DNA, 23 bp, Homo sapiens
gagtcccaagaaacgacccagcg

SEQ ID NO: 6668 - DNA, 24 bp, Homo sapiens
cttcggccctggaggcctccaagg

SEQ ID NO: 6669 - DNA, 24 bp, Homo sapiens
ccttcggccctggaggcctccaag

SEQ ID NO: 6670 - DNA, 24 bp, Homo sapiens
accttcggccctggaggcctccaa

SEQ ID NO: 6671 - DNA, 24 bp, Homo sapiens
tgtgcccgcaggcccgcagccttc

SEQ ID NO: 6672 - DNA, 24 bp, Homo sapiens
ctgtgcccgcaggcccgcagcctt

SEQ ID NO: 6673 - DNA, 24 bp, Homo sapiens
cctgtgcccgcaggcccgcagcct

SEQ ID NO: 6674 - DNA, 24 bp, Homo sapiens
atgctgagcagatggaacgagaaa

SEQ ID NO: 6675 - DNA, 24 bp, Homo sapiens
tatgctgagcagatggaacgagaa

SEQ ID NO: 6676 - DNA, 24 bp, Homo sapiens
ctatgctgagcagatggaacgaga

SEQ ID NO: 6677 - DNA, 24 bp, Homo sapiens
ctacggaatgggtgagtgtttctt

SEQ ID NO: 6678 - DNA, 24 bp, Homo sapiens
gctacggaatgggtgagtgtttct

SEQ ID NO: 6679 - DNA, 24 bp, Homo sapiens
tgctacggaatgggtgagtgtttc

SEQ ID NO: 6680 - DNA, 24 bp, Homo sapiens
agcccgaaaagcggaccgagaaag

SEQ ID NO: 6681 - DNA, 24 bp, Homo sapiens
aagcccgaaaagcggaccgagaaa

SEQ ID NO: 6682 - DNA, 24 bp, Homo sapiens
gaagcccgaaaagcggaccgagaa

SEQ ID NO: 6683 - DNA, 24 bp, Homo sapiens
cctgagtttgagtgccgaccaacc

SEQ ID NO: 6684 - DNA, 24 bp, Homo sapiens
tcctgagtttgagtgccgaccaac

SEQ ID NO: 6685 - DNA, 24 bp, Homo sapiens
ttcctgagtttgagtgccgaccaa

SEQ ID NO: 6686 - DNA, 23 bp, Homo sapiens
cgccgagcctaccaatggtgccg

SEQ ID NO: 6687 - DNA, 23 bp, Homo sapiens
gacggcttgcagcagtctaagtg

SEQ ID NO: 6688 - DNA, 23 bp, Homo sapiens
gaaggaaccgagcccgtccgaag

SEQ ID NO: 6689 - DNA, 24 bp, Homo sapiens
gagaaacaagccctcacagcccaa

SEQ ID NO: 6690 - DNA, 24 bp, Homo sapiens
tgagaaacaagccctcacagccca

SEQ ID NO: 6691 - DNA, 24 bp, Homo sapiens
atgagaaacaagccctcacagccc

SEQ ID NO: 6692 - DNA, 24 bp, Homo sapiens
tcctttggcagcaggttgtccaga

SEQ ID NO: 6693 - DNA, 24 bp, Homo sapiens
ttcctttggcagcaggttgtccag

SEQ ID NO: 6694 - DNA, 24 bp, Homo sapiens
gttcctttggcagcaggttgtcca

SEQ ID NO: 6695 - DNA, 24 bp, Homo sapiens
gcgctctgcaggtgcgtgccttca

SEQ ID NO: 6696 - DNA, 24 bp, Homo sapiens
agcgctctgcaggtgcgtgccttc

SEQ ID NO: 6697 - DNA, 24 bp, Homo sapiens
cagcgctctgcaggtgcgtgcctt

SEQ ID NO: 6698 - DNA, 24 bp, Homo sapiens
cccatttacagatgctggcccgcg

SEQ ID NO: 6699 - DNA, 24 bp, Homo sapiens
ccccatttacagatgctggcccgc

SEQ ID NO: 6700 - DNA, 24 bp, Homo sapiens
cccccatttacagatgctggcccg

SEQ ID NO: 6701 - DNA, 24 bp, Homo sapiens
cgtggaggaggaggagatggacag

SEQ ID NO: 6702 - DNA, 23 bp, Homo sapiens
aagtgagagtgagcctgctgacc

SEQ ID NO: 6703 - DNA, 23 bp, Homo sapiens
aagccttgatggattctacagcc

SEQ ID NO: 6704 - DNA, 25 bp, Homo sapiens
acagcaagctcccttatatggtgat

SEQ ID NO: 6705 - DNA, 23 bp, Homo sapiens
agtgctgcttgctgaagaggaca

SEQ ID NO: 6706 - DNA, 25 bp, Homo sapiens
aagatgatgtagtgttttacttggt

SEQ ID NO: 6707 - DNA, 24 bp, Homo sapiens
agaaacaagccctcacagcccaag

SEQ ID NO: 6708 - DNA, 23 bp, Homo sapiens
ccgcagtcctcctggtggatgaa

SEQ ID NO: 6709 - DNA, 25 bp, Homo sapiens
actggagttggcaatgatgagaaca

SEQ ID NO: 6710 - DNA, 25 bp, Homo sapiens
atcagcaaggtcaatgagtcaacag

SEQ ID NO: 6711 - DNA, 25 bp, Homo sapiens
actggagttggcaatgatgagaaca

SEQ ID NO: 6712 - DNA, 23 bp, Homo sapiens
ccgcagtcctcctggtggatgaa

SEQ ID NO: 6713 - DNA, 24 bp, Homo sapiens
tcgttgggaatgaagctgcagtaa

SEQ ID NO: 6714 - DNA, 24 bp, Homo sapiens
gtcgttgggaatgaagctgcagta

SEQ ID NO: 6715 - DNA, 24 bp, Homo sapiens
agtcgttgggaatgaagctgcagt

SEQ ID NO: 6716 - DNA, 25 bp, Homo sapiens
cagacttgagccactgtgtcaggat

SEQ ID NO: 6717 - DNA, 23 bp, Homo sapiens
caggctggtcttgaacttgcttc

SEQ ID NO: 6718 - DNA, 23 bp, Homo sapiens
tcccgcttcagccccccgagtag

SEQ ID NO: 6719 - DNA, 23 bp, Homo sapiens
ggctcttggtggtatcgctcaat

SEQ ID NO: 6720 - DNA, 25 bp, Homo sapiens
accagattctaatacgcacaacaca

SEQ ID NO: 6721 - DNA, 24 bp, Homo sapiens
gccacaagcagaccaacggataat

SEQ ID NO: 6722 - DNA, 25 bp, Homo sapiens
gtggatactttgccgtcaattaagc

SEQ ID NO: 6723 - DNA, 23 bp, Homo sapiens
cttcctgcctgatgcctacctgc

SEQ ID NO: 6724 - DNA, 24 bp, Homo sapiens
cctctccgagtctgtcacctggat

SEQ ID NO: 6725 - DNA, 24 bp, Homo sapiens
aagtagctgggactacaggcatga

SEQ ID NO: 6726 - DNA, 24 bp, Homo sapiens
caagtagctgggactacaggcatg

SEQ ID NO: 6727 - DNA, 24 bp, Homo sapiens
ccaagtagctgggactacaggcat

SEQ ID NO: 6728 - DNA, 24 bp, Homo sapiens
aaagtgctgggactacaggcatga

SEQ ID NO: 6729 - DNA, 24 bp, Homo sapiens
caaagtgctgggactacaggcatg

SEQ ID NO: 6730 - DNA, 24 bp, Homo sapiens
ccaaagtgctgggactacaggcat

SEQ ID NO: 6731 - DNA, 24 bp, Homo sapiens
aagtagctgggattacaggcgcat

SEQ ID NO: 6732 - DNA, 24 bp, Homo sapiens
caagtagctgggattacaggcgca

SEQ ID NO: 6733 - DNA, 24 bp, Homo sapiens
ccaagtagctgggattacaggcgc

SEQ ID NO: 6734 - DNA, 24 bp, Homo sapiens
ttggaaagaggcaggtacggaagc

SEQ ID NO: 6735 - DNA, 23 bp, Homo sapiens
tgggaggccaaggcaggtggatc

SEQ ID NO: 6736 - DNA, 24 bp, Homo sapiens
ttcaagcaattctcccacctcagc

SEQ ID NO: 6737 - DNA, 24 bp, Homo sapiens
gttcaagcaattctcccacctcag

SEQ ID NO: 6738 - DNA, 24 bp, Homo sapiens
ggttcaagcaattctcccacctca

SEQ ID NO: 6739 - DNA, 24 bp, Homo sapiens
ctcaggtgatcctcctgcctcggc

SEQ ID NO: 6740 - DNA, 24 bp, Homo sapiens
cctcaggtgatcctcctgcctcgg

SEQ ID NO: 6741 - DNA, 24 bp, Homo sapiens
acctcaggtgatcctcctgcctcg

SEQ ID NO: 6742 - DNA, 25 bp, Homo sapiens
caagatgatggtcctcagcagagac

SEQ ID NO: 6743 - DNA, 25 bp, Homo sapiens
tgtagaggactcaagtcagagacca

SEQ ID NO: 6744 - DNA, 23 bp, Homo sapiens
aaccaggaggccatcaccgccat

SEQ ID NO: 6745 - DNA, 24 bp, Homo sapiens
acccctcacagccggtgtttgccc

SEQ ID NO: 6746 - DNA, 24 bp, Homo sapiens
tacccctcacagccggtgtttgcc

SEQ ID NO: 6747 - DNA, 24 bp, Homo sapiens
ctacccctcacagccggtgtttgc

SEQ ID NO: 6748 - DNA, 24 bp, Homo sapiens
gccatcgtgtcatcctctacccct

SEQ ID NO: 6749 - DNA, 24 bp, Homo sapiens
tacaaccctcagcagttcccaggc

SEQ ID NO: 6750 - DNA, 24 bp, Homo sapiens
gctgccacgccctattcttcctac

SEQ ID NO: 6751 - DNA, 24 bp, Homo sapiens
ctgcaaatcaggtagtaaagccag

SEQ ID NO: 6752 - DNA, 24 bp, Homo sapiens
cctgcaaatcaggtagtaaagcca

SEQ ID NO: 6753 - DNA, 24 bp, Homo sapiens
ccctgcaaatcaggtagtaaagcc

SEQ ID NO: 6754 - DNA, 23 bp, Homo sapiens
gccacttcctggaactaaagcat

SEQ ID NO: 6755 - DNA, 25 bp, Homo sapiens
caatggacaaatatgctgtgtttaa

SEQ ID NO: 6756 - DNA, 23 bp, Homo sapiens
tgcagctgacaagtcctctgaaa

SEQ ID NO: 6757 - DNA, 25 bp, Homo sapiens
cggaggactcgttatctgtagatca

SEQ ID NO: 6758 - DNA, 24 bp, Homo sapiens
ctgagccagtggacttgtcaataa

SEQ ID NO: 6759 - DNA, 25 bp, Homo sapiens
tgcctcctcaccttcttcaacttca

SEQ ID NO: 6760 - DNA, 24 bp, Homo sapiens
ccccttccgagccactcaagccac

SEQ ID NO: 6761 - DNA, 24 bp, Homo sapiens
tccccttccgagccactcaagcca

SEQ ID NO: 6762 - DNA, 24 bp, Homo sapiens
ttccccttccgagccactcaagcc

SEQ ID NO: 6763 - DNA, 24 bp, Homo sapiens
tttgcacatagatggcaagatctt

SEQ ID NO: 6764 - DNA, 24 bp, Homo sapiens
ctttgcacatagatggcaagatct

SEQ ID NO: 6765 - DNA, 24 bp, Homo sapiens
tctttgcacatagatggcaagatc

SEQ ID NO: 6766 - DNA, 24 bp, Homo sapiens
gtgtgattcagctggcggaggcag

SEQ ID NO: 6767 - DNA, 24 bp, Homo sapiens
tgtgtgattcagctggcggaggca

SEQ ID NO: 6768 - DNA, 24 bp, Homo sapiens
gtgtgtgattcagctggcggaggc

SEQ ID NO: 6769 - DNA, 24 bp, Homo sapiens
ggcgagctgggattaaggtcaccg

SEQ ID NO: 6770 - DNA, 24 bp, Homo sapiens
aggcgagctgggattaaggtcacc

SEQ ID NO: 6771 - DNA, 24 bp, Homo sapiens
gaggcgagctgggattaaggtcac

SEQ ID NO: 6772 - DNA, 23 bp, Homo sapiens
cccagctcagctcagcccagccc

SEQ ID NO: 6773 - DNA, 23 bp, Homo sapiens
gccccaggcggtgcttctcccca

SEQ ID NO: 6774 - DNA, 23 bp, Homo sapiens
gcccagcccactctgcccttaga

SEQ ID NO: 6775 - DNA, 24 bp, Homo sapiens
ctccccaaagacgcactccagaag

SEQ ID NO: 6776 - DNA, 23 bp, Homo sapiens
tgcttctccccaccaccgcccag

SEQ ID NO: 6777 - DNA, 25 bp, Homo sapiens
caacaaccttctcctacacattggc

SEQ ID NO: 6778 - DNA, 25 bp, Homo sapiens
aacatctccaatggcaactactacc

SEQ ID NO: 6779 - DNA, 24 bp, Homo sapiens
atctgcctggtgacctcctccttc

SEQ ID NO: 6780 - DNA, 25 bp, Homo sapiens
caacaaccttctcctacacattggc

SEQ ID NO: 6781 - DNA, 25 bp, Homo sapiens
cctgacctgttcatacctgagccat

SEQ ID NO: 6782 - DNA, 25 bp, Homo sapiens
gctatgaatatgtggactgccgagg

SEQ ID NO: 6783 - DNA, 25 bp, Homo sapiens
cctgacctgttcatacctgagccat

SEQ ID NO: 6784 - DNA, 25 bp, Homo sapiens
gctatgaatatgtggactgccgagg

SEQ ID NO: 6785 - DNA, 25 bp, Homo sapiens
tgactaaggaaggactacagaggct

SEQ ID NO: 6786 - DNA, 25 bp, Homo sapiens
tcaagcgattctcctgtctcagcct

SEQ ID NO: 6787 - DNA, 23 bp, Homo sapiens
ggtcggtgcggatattcagtcat

SEQ ID NO: 6788 - DNA, 23 bp, Homo sapiens
tttctgtgcctttgggtgcggac

SEQ ID NO: 6789 - DNA, 24 bp, Homo sapiens
cggctggcaagactgtttgtgttg

SEQ ID NO: 6790 - DNA, 24 bp, Homo sapiens
gtctcaaactcctgggctcaagca

SEQ ID NO: 6791 - DNA, 23 bp, Homo sapiens
ccttggcctcccaaagcactgga

SEQ ID NO: 6792 - DNA, 24 bp, Homo sapiens
cctcagcctcggtgccttggaatt

SEQ ID NO: 6793 - DNA, 24 bp, Homo sapiens
tcctcagcctcggtgccttggaat

SEQ ID NO: 6794 - DNA, 24 bp, Homo sapiens
ctcctcagcctcggtgccttggaa

SEQ ID NO: 6795 - DNA, 24 bp, Homo sapiens
agggccgcaaggtgagtgccacca

SEQ ID NO: 6796 - DNA, 24 bp, Homo sapiens
cagggccgcaaggtgagtgccacc

SEQ ID NO: 6797 - DNA, 24 bp, Homo sapiens
ccagggccgcaaggtgagtgccac

SEQ ID NO: 6798 - DNA, 23 bp, Homo sapiens
gcaattctcctcgctcagcctcc

SEQ ID NO: 6799 - DNA, 23 bp, Homo sapiens
gctcaagtgatctgcctgcctcg

SEQ ID NO: 6800 - DNA, 24 bp, Homo sapiens
caatggcacaatcttggctcactg

SEQ ID NO: 6801 - DNA, 24 bp, Homo sapiens
acctcaagtaatccacctgcctcg

SEQ ID NO: 6802 - DNA, 24 bp, Homo sapiens
gcagtggcacagtcttggctcatt

SEQ ID NO: 6803 - DNA, 24 bp, Homo sapiens
ccgcctcccagattcaagcagttc

SEQ ID NO: 6804 - DNA, 24 bp, Homo sapiens
gccgacaaggtcctgaaggagaag

SEQ ID NO: 6805 - DNA, 23 bp, Homo sapiens
acacaagaagggtaggagagaaa

SEQ ID NO: 6806 - DNA, 24 bp, Homo sapiens
cggccatcgtgccacctgtttttc

SEQ ID NO: 6807 - DNA, 24 bp, Homo sapiens
ccggccatcgtgccacctgttttt

SEQ ID NO: 6808 - DNA, 24 bp, Homo sapiens
accggccatcgtgccacctgtttt

SEQ ID NO: 6809 - DNA, 24 bp, Homo sapiens
catgggccgcggtgtgggctaagc

SEQ ID NO: 6810 - DNA, 24 bp, Homo sapiens
ccatgggccgcggtgtgggctaag

SEQ ID NO: 6811 - DNA, 24 bp, Homo sapiens
accatgggccgcggtgtgggctaa

SEQ ID NO: 6812 - DNA, 24 bp, Homo sapiens
tgtgttatcaggcacgcgggagct

SEQ ID NO: 6813 - DNA, 24 bp, Homo sapiens
ctgtgttatcaggcacgcgggagc

SEQ ID NO: 6814 - DNA, 24 bp, Homo sapiens
tctgtgttatcaggcacgcgggag

SEQ ID NO: 6815 - DNA, 24 bp, Homo sapiens
gatcacttgaggtgtgggctaagc

SEQ ID NO: 6816 - DNA, 24 bp, Homo sapiens
ggatcacttgaggtgtgggctaag

SEQ ID NO: 6817 - DNA, 24 bp, Homo sapiens
cggatcacttgaggtgtgggctaa

SEQ ID NO: 6818 - DNA, 25 bp, Homo sapiens
aagagaatagtaggtctgctcagcc

SEQ ID NO: 6819 - DNA, 25 bp, Homo sapiens
aaacttgggagtagtggctgaataa

SEQ ID NO: 6820 - DNA, 24 bp, Homo sapiens
agaaagtctttggccactggataa

SEQ ID NO: 6821 - DNA, 24 bp, Homo sapiens
gagggccgctggtggcagccgagt

SEQ ID NO: 6822 - DNA, 24 bp, Homo sapiens
agagggccgctggtggcagccgag

SEQ ID NO: 6823 - DNA, 24 bp, Homo sapiens
cagagggccgctggtggcagccga

SEQ ID NO: 6824 - DNA, 24 bp, Homo sapiens
gaactcgggagacatcaccacgga

SEQ ID NO: 6825 - DNA, 24 bp, Homo sapiens
agaactcgggagacatcaccacgg

SEQ ID NO: 6826 - DNA, 24 bp, Homo sapiens
aagaactcgggagacatcaccacg

SEQ ID NO: 6827 - DNA, 24 bp, Homo sapiens
gaactcgggaggtgaggcccagtc

SEQ ID NO: 6828 - DNA, 24 bp, Homo sapiens
agaactcgggaggtgaggcccagt

SEQ ID NO: 6829 - DNA, 24 bp, Homo sapiens
aagaactcgggaggtgaggcccag

SEQ ID NO: 6830 - DNA, 24 bp, Homo sapiens
atgatcaaaacgtatgtggtgcca

SEQ ID NO: 6831 - DNA, 24 bp, Homo sapiens
catgatcaaaacgtatgtggtgcc

SEQ ID NO: 6832 - DNA, 24 bp, Homo sapiens
ccatgatcaaaacgtatgtggtgc

SEQ ID NO: 6833 - DNA, 23 bp, Homo sapiens
tcagccacaccccagcagccatc

SEQ ID NO: 6834 - DNA, 23 bp, Homo sapiens
ccttcccagtatgggatggccgg

SEQ ID NO: 6835 - DNA, 24 bp, Homo sapiens
gccgcctcgtctcaagttgtataa

SEQ ID NO: 6836 - DNA, 24 bp, Homo sapiens
tgcttcgccacagactcttgttcc

SEQ ID NO: 6837 - DNA, 23 bp, Homo sapiens
agcaccaccagcaccagatcctc

SEQ ID NO: 6838 - DNA, 25 bp, Homo sapiens
gcattcttcccttggttcagcacag

SEQ ID NO: 6839 - DNA, 23 bp, Homo sapiens
tcaccagctcacgtcatgttgcc

SEQ ID NO: 6840 - DNA, 23 bp, Homo sapiens
ttttttcccctttccctccctcc

SEQ ID NO: 6841 - DNA, 24 bp, Homo sapiens
aggataaaccagaagccatgccgc

SEQ ID NO: 6842 - DNA, 24 bp, Homo sapiens
gtgctgttcccgatgacccttctc

SEQ ID NO: 6843 - DNA, 24 bp, Homo sapiens
ttccaaaccaccacctctcttcca

SEQ ID NO: 6844 - DNA, 24 bp, Homo sapiens
tcaatacctcagccacctcctcgg

SEQ ID NO: 6845 - DNA, 24 bp, Homo sapiens
ctcacagcagaggcagagtagtaa

SEQ ID NO: 6846 - DNA, 24 bp, Homo sapiens
cgacccaggcaagttctgtgtgat

SEQ ID NO: 6847 - DNA, 23 bp, Homo sapiens
gcagtggcatgatctcggctcac

SEQ ID NO: 6848 - DNA, 23 bp, Homo sapiens
tgcctcaccctcccgagtagttg

SEQ ID NO: 6849 - DNA, 23 bp, Homo sapiens
ctccaccacccgagttcaagtga

SEQ ID NO: 6850 - DNA, 24 bp, Homo sapiens
ctcacgcctgtaatcccagctctt

SEQ ID NO: 6851 - DNA, 24 bp, Homo sapiens
gctcacgcctgtaatcccagctct

SEQ ID NO: 6852 - DNA, 24 bp, Homo sapiens
ggctcacgcctgtaatcccagctc

SEQ ID NO: 6853 - DNA, 24 bp, Homo sapiens
cggttcaagcgattctcctgcctc

SEQ ID NO: 6854 - DNA, 23 bp, Homo sapiens
aatctccgctcactgcaacctct

SEQ ID NO: 6855 - DNA, 24 bp, Homo sapiens
gttgatctgtggtgagttgggcaa

SEQ ID NO: 6856 - DNA, 24 bp, Homo sapiens
tgttgatctgtggtgagttgggca

SEQ ID NO: 6857 - DNA, 24 bp, Homo sapiens
ctgttgatctgtggtgagttgggc

SEQ ID NO: 6858 - DNA, 25 bp, Homo sapiens
cttagacatctattccaggctgagg

SEQ ID NO: 6859 - DNA, 25 bp, Homo sapiens
catctactgtgaagtgaagttggcg

SEQ ID NO: 6860 - DNA, 25 bp, Homo sapiens
tgttatcagaaccagattcctgccg

SEQ ID NO: 6861 - DNA, 24 bp, Homo sapiens
agtggaggatgtgctggagcttca

SEQ ID NO: 6862 - DNA, 25 bp, Homo sapiens
gccagaagcaatcatcttacctcag

SEQ ID NO: 6863 - DNA, 25 bp, Homo sapiens
gttcacctacctcaactcacctacc

SEQ ID NO: 6864 - DNA, 24 bp, Homo sapiens
gttgatctgtgagctgtttttgat

SEQ ID NO: 6865 - DNA, 24 bp, Homo sapiens
tgttgatctgtgagctgtttttga

SEQ ID NO: 6866 - DNA, 24 bp, Homo sapiens
ctgttgatctgtgagctgtttttg

SEQ ID NO: 6867 - DNA, 24 bp, Homo sapiens
ccgaggctgttgctgttgatctgt

SEQ ID NO: 6868 - DNA, 23 bp, Homo sapiens
gtaccatccctgacctggtcctc

SEQ ID NO: 6869 - DNA, 24 bp, Homo sapiens
cctacctcaactcacctaccccag

SEQ ID NO: 6870 - DNA, 23 bp, Homo sapiens
ccttcccagccctctaccccaag

SEQ ID NO: 6871 - DNA, 24 bp, Homo sapiens
aagacgttcagccagggatccact

SEQ ID NO: 6872 - DNA, 25 bp, Homo sapiens
gcagtggtatggtcatggctcattg

SEQ ID NO: 6873 - DNA, 24 bp, Homo sapiens
aatcctcccacctcagccttccaa

SEQ ID NO: 6874 - DNA, 25 bp, Homo sapiens
ggaaccagagacacatgcaaccaca

SEQ ID NO: 6875 - DNA, 23 bp, Homo sapiens
cctgacctggtcctcatgctgcc

SEQ ID NO: 6876 - DNA, 23 bp, Homo sapiens
tttgatgagaggcatctctaggt

SEQ ID NO: 6877 - DNA, 25 bp, Homo sapiens
gcaatcatcttacctcaggagtcat

SEQ ID NO: 6878 - DNA, 25 bp, Homo sapiens
gttcacctacctcaactcacctacc

SEQ ID NO: 6879 - DNA, 24 bp, Homo sapiens
gggatgaggtttattcactggcgt

SEQ ID NO: 6880 - DNA, 25 bp, Homo sapiens
gccagaagcaatcatcttacctcag

SEQ ID NO: 6881 - DNA, 25 bp, Homo sapiens
agcctccttcaacctttccctgact

SEQ ID NO: 6882 - DNA, 25 bp, Homo sapiens
gctctcctccgatcctgtactggtt

SEQ ID NO: 6883 - DNA, 25 bp, Homo sapiens
gttcacctacctcaactcacctacc

SEQ ID NO: 6884 - DNA, 25 bp, Homo sapiens
gttcacctacctcaactcacctacc

SEQ ID NO: 6885 - DNA, 25 bp, Homo sapiens
gccagaagcaatcatcttacctcag

SEQ ID NO: 6886 - DNA, 25 bp, Homo sapiens
agcctccttcaacctttccctgact

SEQ ID NO: 6887 - DNA, 24 bp, Homo sapiens
gggatgaggtttattcactggcgt

SEQ ID NO: 6888 - DNA, 25 bp, Homo sapiens
gttcacctacctcaactcacctacc

SEQ ID NO: 6889 - DNA, 25 bp, Homo sapiens
gccagaagcaatcatcttacctcag

SEQ ID NO: 6890 - DNA, 24 bp, Homo sapiens
ctccgcctcccgagaatctcttga

SEQ ID NO: 6891 - DNA, 24 bp, Homo sapiens
cctccgcctcccgagaatctcttg

SEQ ID NO: 6892 - DNA, 24 bp, Homo sapiens
acctccgcctcccgagaatctctt

SEQ ID NO: 6893 - DNA, 24 bp, Homo sapiens
tgacccctgaggttcgcctttggc

SEQ ID NO: 6894 - DNA, 24 bp, Homo sapiens
ctgacccctgaggttcgcctttgg

SEQ ID NO: 6895 - DNA, 24 bp, Homo sapiens
cctgacccctgaggttcgcctttg

SEQ ID NO: 6896 - DNA, 24 bp, Homo sapiens
ggtgtttgactattgaaaaggcca

SEQ ID NO: 6897 - DNA, 24 bp, Homo sapiens
cggtgtttgactattgaaaaggcc

SEQ ID NO: 6898 - DNA, 24 bp, Homo sapiens
acggtgtttgactattgaaaaggc

SEQ ID NO: 6899 - DNA, 24 bp, Homo sapiens
tgaagaccaagccaccattggcgc

SEQ ID NO: 6900 - DNA, 24 bp, Homo sapiens
ttgaagaccaagccaccattggcg

SEQ ID NO: 6901 - DNA, 24 bp, Homo sapiens
tttgaagaccaagccaccattggc

SEQ ID NO: 6902 - DNA, 24 bp, Homo sapiens
tagactgccacactgtcccgttgt

SEQ ID NO: 6903 - DNA, 24 bp, Homo sapiens
aaggaactgagacttctcttcatt

SEQ ID NO: 6904 - DNA, 23 bp, Homo sapiens
ttttccttccccacctttcccta

SEQ ID NO: 6905 - DNA, 24 bp, Homo sapiens
ctagcaatcagcgagattccgtgg

SEQ ID NO: 6906 - DNA, 25 bp, Homo sapiens
ttacctaagcaagcctgggcaatgg

SEQ ID NO: 6907 - DNA, 24 bp, Homo sapiens
gccgccttgcagtttgatctcaga

SEQ ID NO: 6908 - DNA, 24 bp, Homo sapiens
tgaggacccagcgaaacatcggat

SEQ ID NO: 6909 - DNA, 24 bp, Homo sapiens
ttgaggacccagcgaaacatcgga

SEQ ID NO: 6910 - DNA, 24 bp, Homo sapiens
attgaggacccagcgaaacatcgg

SEQ ID NO: 6911 - DNA, 24 bp, Homo sapiens
ccagggggatggagtggacctggt

SEQ ID NO: 6912 - DNA, 24 bp, Homo sapiens
gccagggggatggagtggacctgg

SEQ ID NO: 6913 - DNA, 24 bp, Homo sapiens
cgccagggggatggagtggacctg

SEQ ID NO: 6914 - DNA, 24 bp, Homo sapiens
tgacagttcagatgtgtcgaccct

SEQ ID NO: 6915 - DNA, 24 bp, Homo sapiens
ctgacagttcagatgtgtcgaccc

SEQ ID NO: 6916 - DNA, 24 bp, Homo sapiens
actgacagttcagatgtgtcgacc

SEQ ID NO: 6917 - DNA, 23 bp, Homo sapiens
agtgattctcctgcctcggcctc

SEQ ID NO: 6918 - DNA, 23 bp, Homo sapiens
ctctctgcaacctccgcctccca

SEQ ID NO: 6919 - DNA, 23 bp, Homo sapiens
caggctggagtgcagtggtgcga

SEQ ID NO: 6920 - DNA, 24 bp, Homo sapiens
tgggattacaggcacccaccacca

SEQ ID NO: 6921 - DNA, 24 bp, Homo sapiens
ctgggattacaggcacccaccacc

SEQ ID NO: 6922 - DNA, 24 bp, Homo sapiens
gctgggattacaggcacccaccac

SEQ ID NO: 6923 - DNA, 24 bp, Homo sapiens
cacaggaccaagggccgaatgctg

SEQ ID NO: 6924 - DNA, 24 bp, Homo sapiens
ctgcaccttccgggacctgcgttt

SEQ ID NO: 6925 - DNA, 24 bp, Homo sapiens
ggacatcatggtgcgggatgttcc

SEQ ID NO: 6926 - DNA, 24 bp, Homo sapiens
ggttcaatccattctcctgcctca

SEQ ID NO: 6927 - DNA, 24 bp, Homo sapiens
ttgatggagtcttgttctgttgcc

SEQ ID NO: 6928 - DNA, 24 bp, Homo sapiens
gctgttctcgaatgcctgacctca

SEQ ID NO: 6929 - DNA, 24 bp, Homo sapiens
taagggttcagagcagccagattc

SEQ ID NO: 6930 - DNA, 24 bp, Homo sapiens
tgcccggtaacactacacacaaga

SEQ ID NO: 6931 - DNA, 24 bp, Homo sapiens
actctggtccagcaaataatttgt

SEQ ID NO: 6932 - DNA, 24 bp, Homo sapiens
tgtccaggacgatgagacactcaa

SEQ ID NO: 6933 - DNA, 24 bp, Homo sapiens
ttgtccaggacgatgagacactca

SEQ ID NO: 6934 - DNA, 24 bp, Homo sapiens
tttgtccaggacgatgagacactc

SEQ ID NO: 6935 - DNA, 23 bp, Homo sapiens
aaatggaggagcagcagcagtca

SEQ ID NO: 6936 - DNA, 25 bp, Homo sapiens
aaggaagagatcacatagcagtgcc

SEQ ID NO: 6937 - DNA, 25 bp, Homo sapiens
ctgattgggatgacaaggattggga

SEQ ID NO: 6938 - DNA, 24 bp, Homo sapiens
tgcgtgattcccgtgattgcgtta

SEQ ID NO: 6939 - DNA, 23 bp, Homo sapiens
attttgttgttggtgcgcgacgc

SEQ ID NO: 6940 - DNA, 25 bp, Homo sapiens
catagcagtgcccaggagaacaagc

SEQ ID NO: 6941 - DNA, 25 bp, Homo sapiens
aatggaggagcagcagcagtcataa

SEQ ID NO: 6942 - DNA, 25 bp, Homo sapiens
ctgattgggatgacaaggattggga

SEQ ID NO: 6943 - DNA, 24 bp, Homo sapiens
ctcccctacagtcctccatgataa

SEQ ID NO: 6944 - DNA, 24 bp, Homo sapiens
tctcccctacagtcctccatgata

SEQ ID NO: 6945 - DNA, 24 bp, Homo sapiens
ttctcccctacagtcctccatgat

SEQ ID NO: 6946 - DNA, 24 bp, Homo sapiens
accgccttggccttcctgtctctg

SEQ ID NO: 6947 - DNA, 24 bp, Homo sapiens
caccgccttggccttcctgtctct

SEQ ID NO: 6948 - DNA, 24 bp, Homo sapiens
ccaccgccttggccttcctgtctc

SEQ ID NO: 6949 - DNA, 25 bp, Homo sapiens
atggaagtgcctgtcatggtagtaa

SEQ ID NO: 6950 - DNA, 25 bp, Homo sapiens
gcgagtgagtaggttaagcacaagt

SEQ ID NO: 6951 - DNA, 25 bp, Homo sapiens
cgaagaagtcctgtcacctgaaggc

SEQ ID NO: 6952 - DNA, 25 bp, Homo sapiens
aggaccacaatctcagttgcttgct

SEQ ID NO: 6953 - DNA, 24 bp, Homo sapiens
tggataagccaccttctactatgc

SEQ ID NO: 6954 - DNA, 25 bp, Homo sapiens
ctcacagaaggagaacttgaagagt

SEQ ID NO: 6955 - DNA, 25 bp, Homo sapiens
aggaccacaatctcagttgcttgct

SEQ ID NO: 6956 - DNA, 25 bp, Homo sapiens
ctcacagaaggagaacttgaagagt

SEQ ID NO: 6957 - DNA, 25 bp, Homo sapiens
atggaagtgcctgtcatggtagtaa

SEQ ID NO: 6958 - DNA, 24 bp, Homo sapiens
ccggaacctcggcctctactccag

SEQ ID NO: 6959 - DNA, 24 bp, Homo sapiens
tccggaacctcggcctctactcca

SEQ ID NO: 6960 - DNA, 24 bp, Homo sapiens
gtccggaacctcggcctctactcc

SEQ ID NO: 6961 - DNA, 24 bp, Homo sapiens
ttggctaggctggtcttgaactcc

SEQ ID NO: 6962 - DNA, 24 bp, Homo sapiens
caggcatggtggctcacatctgta

SEQ ID NO: 6963 - DNA, 24 bp, Homo sapiens
atccgcccacctcaacctcccaaa

SEQ ID NO: 6964 - DNA, 24 bp, Homo sapiens
gattctccagcctcagcctcccga

SEQ ID NO: 6965 - DNA, 24 bp, Homo sapiens
tgattctccagcctcagcctcccg

SEQ ID NO: 6966 - DNA, 24 bp, Homo sapiens
gtgattctccagcctcagcctccc

SEQ ID NO: 6967 - DNA, 24 bp, Homo sapiens
gtggtcccagctactcgggaggct

SEQ ID NO: 6968 - DNA, 24 bp, Homo sapiens
tgtggtcccagctactcgggaggc

SEQ ID NO: 6969 - DNA, 24 bp, Homo sapiens
ctgtggtcccagctactcgggagg

SEQ ID NO: 6970 - DNA, 24 bp, Homo sapiens
ttggctaggctggtcttgaactcc

SEQ ID NO: 6971 - DNA, 24 bp, Homo sapiens
ggagactaaggcaggcggatcacc

SEQ ID NO: 6972 - DNA, 24 bp, Homo sapiens
atccgcccacctcaacctcccaaa

SEQ ID NO: 6973 - DNA, 24 bp, Homo sapiens
gggaggctgaggcacaagaatcac

SEQ ID NO: 6974 - DNA, 24 bp, Homo sapiens
cgggaggctgaggcacaagaatca

SEQ ID NO: 6975 - DNA, 24 bp, Homo sapiens
tcgggaggctgaggcacaagaatc

SEQ ID NO: 6976 - DNA, 24 bp, Homo sapiens
aggatcaacaggtacagtgttttt

SEQ ID NO: 6977 - DNA, 24 bp, Homo sapiens
aaggatcaacaggtacagtgtttt

SEQ ID NO: 6978 - DNA, 24 bp, Homo sapiens
aaaggatcaacaggtacagtgttt

SEQ ID NO: 6979 - DNA, 24 bp, Homo sapiens
tcatggcacagattttgacagtga

SEQ ID NO: 6980 - DNA, 24 bp, Homo sapiens
atcatggcacagattttgacagtg

SEQ ID NO: 6981 - DNA, 24 bp, Homo sapiens
aatcatggcacagattttgacagt

SEQ ID NO: 6982 - DNA, 24 bp, Homo sapiens
agcacagctaggaagccttaaaaa

SEQ ID NO: 6983 - DNA, 24 bp, Homo sapiens
cagcacagctaggaagccttaaaa

SEQ ID NO: 6984 - DNA, 24 bp, Homo sapiens
acagcacagctaggaagccttaaa

SEQ ID NO: 6985 - DNA, 24 bp, Homo sapiens
gtttgagagagtctcagaggagca

SEQ ID NO: 6986 - DNA, 24 bp, Homo sapiens
tgtttgagagagtctcagaggagc

SEQ ID NO: 6987 - DNA, 24 bp, Homo sapiens
ctgtttgagagagtctcagaggag

SEQ ID NO: 6988 - DNA, 25 bp, Homo sapiens
tccaagcagtttgtctgaccacagg

SEQ ID NO: 6989 - DNA, 25 bp, Homo sapiens
tttgacagtgaaagtggaaggttgt

SEQ ID NO: 6990 - DNA, 25 bp, Homo sapiens
ctttgtggaacccaagtggctttgt

SEQ ID NO: 6991 - DNA, 25 bp, Homo sapiens
agtgacttgtactttgtggaaccca

SEQ ID NO: 6992 - DNA, 24 bp, Homo sapiens
gcttcctcacgcagttcactttct

SEQ ID NO: 6993 - DNA, 25 bp, Homo sapiens
ccgagatcagcttgttgttggacag

SEQ ID NO: 6994 - DNA, 25 bp, Homo sapiens
agtgacttgtactttgtggaaccca

SEQ ID NO: 6995 - DNA, 24 bp, Homo sapiens
gaattttcttgcttgcggtcttta

SEQ ID NO: 6996 - DNA, 24 bp, Homo sapiens
tgaattttcttgcttgcggtcttt

SEQ ID NO: 6997 - DNA, 24 bp, Homo sapiens
atgaattttcttgcttgcggtctt

SEQ ID NO: 6998 - DNA, 25 bp, Homo sapiens
ctctggatgtcagttacaacttgga

SEQ ID NO: 6999 - DNA, 25 bp, Homo sapiens
tgattgtgggaaatactgggagtgg

SEQ ID NO: 7000 - DNA, 25 bp, Homo sapiens
gttggcatagatgtgaaagactggc

SEQ ID NO: 7001 - DNA, 25 bp, Homo sapiens
gttggcatagatgtgaaagactggc

SEQ ID NO: 7002 - DNA, 25 bp, Homo sapiens
tgattgtgggaaatactgggagtgg

SEQ ID NO: 7003 - DNA, 25 bp, Homo sapiens
tctctggatgtcagttacaacttgg

SEQ ID NO: 7004 - DNA, 24 bp, Homo sapiens
gcaagggacaggctgaagttgatg

SEQ ID NO: 7005 - DNA, 24 bp, Homo sapiens
tgacgcagcgagcattgtaccttg

SEQ ID NO: 7006 - DNA, 25 bp, Homo sapiens
gttggcatagatgtgaaagactggc

SEQ ID NO: 7007 - DNA, 24 bp, Homo sapiens
gcttcctcacgcagttcactttct

SEQ ID NO: 7008 - DNA, 25 bp, Homo sapiens
ccgagatcagcttgttgttggacag

SEQ ID NO: 7009 - DNA, 25 bp, Homo sapiens
tgaatgccaccgaggaatctgatgc

SEQ ID NO: 7010 - DNA, 24 bp, Homo sapiens
ctttcagggagagaacgagcactt

SEQ ID NO: 7011 - DNA, 25 bp, Homo sapiens
aacagaatgtattggcgacaaggca

SEQ ID NO: 7012 - DNA, 25 bp, Homo sapiens
gaagaatggtttcctgggttgctgg

SEQ ID NO: 7013 - DNA, 25 bp, Homo sapiens
tctttggataggaactggaggaggc

SEQ ID NO: 7014 - DNA, 24 bp, Homo sapiens
actcctggatctttcaactcgtcg

SEQ ID NO: 7015 - DNA, 25 bp, Homo sapiens
tgatgacagcacagctaggaagcct

SEQ ID NO: 7016 - DNA, 24 bp, Homo sapiens
actcctggatctttcaactcgtcg

SEQ ID NO: 7017 - DNA, 23 bp, Homo sapiens
ttggataggaactggaggaggcc

SEQ ID NO: 7018 - DNA, 25 bp, Homo sapiens
aaaccctctgccttcagaagaacac

SEQ ID NO: 7019 - DNA, 24 bp, Homo sapiens
gctgaccttcggcttcatcaccat

SEQ ID NO: 7020 - DNA, 24 bp, Homo sapiens
tgctgaccttcggcttcatcacca

SEQ ID NO: 7021 - DNA, 24 bp, Homo sapiens
ctgctgaccttcggcttcatcacc

SEQ ID NO: 7022 - DNA, 24 bp, Homo sapiens
attcagtggcatgatcttggctca

SEQ ID NO: 7023 - DNA, 24 bp, Homo sapiens
aagtgctgggattacaggcgtgag

SEQ ID NO: 7024 - DNA, 24 bp, Homo sapiens
caattctcctgcctcagcctcccg

SEQ ID NO: 7025 - DNA, 24 bp, Homo sapiens
ccaccattcaggaagcagccatca

SEQ ID NO: 7026 - DNA, 24 bp, Homo sapiens
accaccattcaggaagcagccatc

SEQ ID NO: 7027 - DNA, 24 bp, Homo sapiens
gaccaccattcaggaagcagccat

SEQ ID NO: 7028 - DNA, 25 bp, Homo sapiens
attacaaccactcctcacacgctcc

SEQ ID NO: 7029 - DNA, 24 bp, Homo sapiens
gctgtgctcatcctcctgctcatc

SEQ ID NO: 7030 - DNA, 23 bp, Homo sapiens
cctgctcccatcctccctgaaga

SEQ ID NO: 7031 - DNA, 23 bp, Homo sapiens
tttcttctctggcgtcgggtcgt

SEQ ID NO: 7032 - DNA, 23 bp, Homo sapiens
gttctggactgctggcactggtg

SEQ ID NO: 7033 - DNA, 23 bp, Homo sapiens
atcggatggatgagcagtcacac

SEQ ID NO: 7034 - DNA, 24 bp, Homo sapiens
ggcctggcctggtttgtatttcag

SEQ ID NO: 7035 - DNA, 24 bp, Homo sapiens
gggcctggcctggtttgtatttca

SEQ ID NO: 7036 - DNA, 24 bp, Homo sapiens
tgggcctggcctggtttgtatttc

SEQ ID NO: 7037 - DNA, 24 bp, Homo sapiens
aactcttgcaggcagcagtacctg

SEQ ID NO: 7038 - DNA, 24 bp, Homo sapiens
gaactcttgcaggcagcagtacct

SEQ ID NO: 7039 - DNA, 24 bp, Homo sapiens
tgaactcttgcaggcagcagtacc

SEQ ID NO: 7040 - DNA, 24 bp, Homo sapiens
atgagatgaaggagactaatgagc

SEQ ID NO: 7041 - DNA, 24 bp, Homo sapiens
catgagatgaaggagactaatgag

SEQ ID NO: 7042 - DNA, 24 bp, Homo sapiens
ccatgagatgaaggagactaatga

SEQ ID NO: 7043 - DNA, 23 bp, Homo sapiens
caagcgatctgcctgcctcggtc

SEQ ID NO: 7044 - DNA, 23 bp, Homo sapiens
tgcccaggctgatctcgaactcc

SEQ ID NO: 7045 - DNA, 24 bp, Homo sapiens
aggacgacgaggaggaggaagatg

SEQ ID NO: 7046 - DNA, 24 bp, Homo sapiens
gaggacgacgaggaggaggaagat

SEQ ID NO: 7047 - DNA, 24 bp, Homo sapiens
ggaggacgacgaggaggaggaaga

SEQ ID NO: 7048 - DNA, 24 bp, Homo sapiens
tgaggcaggagaatggcaggaacc

SEQ ID NO: 7049 - DNA, 24 bp, Homo sapiens
gggcgacagagcgagactccatct

SEQ ID NO: 7050 - DNA, 24 bp, Homo sapiens
ctactcgggaggctgaggcaggag

SEQ ID NO: 7051 - DNA, 23 bp, Homo sapiens
cagactggtctcgaactcctgag

SEQ ID NO: 7052 - DNA, 23 bp, Homo sapiens
caatccccctgcctcggcctccc

SEQ ID NO: 7053 - DNA, 24 bp, Homo sapiens
acgtccaccaggcatctcgaaccc

SEQ ID NO: 7054 - DNA, 24 bp, Homo sapiens
cacgtccaccaggcatctcgaacc

SEQ ID NO: 7055 - DNA, 24 bp, Homo sapiens
ccacgtccaccaggcatctcgaac

SEQ ID NO: 7056 - DNA, 24 bp, Homo sapiens
attccaagacgattgaccccaaag

SEQ ID NO: 7057 - DNA, 24 bp, Homo sapiens
gattccaagacgattgaccccaaa

SEQ ID NO: 7058 - DNA, 24 bp, Homo sapiens
agattccaagacgattgaccccaa

SEQ ID NO: 7059 - DNA, 24 bp, Homo sapiens
ggttcaagcgattctcctgcctca

SEQ ID NO: 7060 - DNA, 23 bp, Homo sapiens
gcagtggcatgatctcggctcac

SEQ ID NO: 7061 - DNA, 24 bp, Homo sapiens
tgttgcccttggcctcccaaagtg

SEQ ID NO: 7062 - DNA, 24 bp, Homo sapiens
gtgttgcccttggcctcccaaagt

SEQ ID NO: 7063 - DNA, 24 bp, Homo sapiens
agtgttgcccttggcctcccaaag

SEQ ID NO: 7064 - DNA, 24 bp, Homo sapiens
aggaggacaaggaggcggcacagc

SEQ ID NO: 7065 - DNA, 24 bp, Homo sapiens
gaggaggacaaggaggcggcacag

SEQ ID NO: 7066 - DNA, 24 bp, Homo sapiens
ggaggaggacaaggaggcggcaca

SEQ ID NO: 7067 - DNA, 24 bp, Homo sapiens
agcacgtgcagagtgtcgatatcg

SEQ ID NO: 7068 - DNA, 24 bp, Homo sapiens
gagcacgtgcagagtgtcgatatc

SEQ ID NO: 7069 - DNA, 24 bp, Homo sapiens
ggagcacgtgcagagtgtcgatat

SEQ ID NO: 7070 - DNA, 24 bp, Homo sapiens
cagaaactgacgtgcaaatcggta

SEQ ID NO: 7071 - DNA, 24 bp, Homo sapiens
ccagaaactgacgtgcaaatcggt

SEQ ID NO: 7072 - DNA, 24 bp, Homo sapiens
tccagaaactgacgtgcaaatcgg

SEQ ID NO: 7073 - DNA, 24 bp, Homo sapiens
tcttcccccagcagccctggcccg

SEQ ID NO: 7074 - DNA, 24 bp, Homo sapiens
ttcttcccccagcagccctggccc

SEQ ID NO: 7075 - DNA, 24 bp, Homo sapiens
tttcttcccccagcagccctggcc

SEQ ID NO: 7076 - DNA, 24 bp, Homo sapiens
cggacctccaggcctccctgtacc

SEQ ID NO: 7077 - DNA, 24 bp, Homo sapiens
ccggacctccaggcctccctgtac

SEQ ID NO: 7078 - DNA, 24 bp, Homo sapiens
cccggacctccaggcctccctgta

SEQ ID NO: 7079 - DNA, 24 bp, Homo sapiens
tcaaaactccgacgtaccgtgagc

SEQ ID NO: 7080 - DNA, 24 bp, Homo sapiens
atcaaaactccgacgtaccgtgag

SEQ ID NO: 7081 - DNA, 24 bp, Homo sapiens
catcaaaactccgacgtaccgtga

SEQ ID NO: 7082 - DNA, 24 bp, Homo sapiens
agggtgacgagggccccccaggca

SEQ ID NO: 7083 - DNA, 24 bp, Homo sapiens
aagggtgacgagggccccccaggc

SEQ ID NO: 7084 - DNA, 24 bp, Homo sapiens
gaagggtgacgagggccccccagg

SEQ ID NO: 7085 - DNA, 25 bp, Homo sapiens
gccagactggtttcaaactcctaac

SEQ ID NO: 7086 - DNA, 23 bp, Homo sapiens
ctggaattacaggtgtgaaccat

SEQ ID NO: 7087 - DNA, 23 bp, Homo sapiens
caatccacctgctttggcctccc

SEQ ID NO: 7088 - DNA, 24 bp, Homo sapiens
aaggacccccgggcccccctggga

SEQ ID NO: 7089 - DNA, 24 bp, Homo sapiens
aaaggacccccgggcccccctggg

SEQ ID NO: 7090 - DNA, 24 bp, Homo sapiens
gaaaggacccccgggcccccctgg

SEQ ID NO: 7091 - DNA, 23 bp, Homo sapiens
ggtcctgctggctcgcctggttc

SEQ ID NO: 7092 - DNA, 23 bp, Homo sapiens
acaaggagggaagggagccaagg

SEQ ID NO: 7093 - DNA, 23 bp, Homo sapiens
tgctggagccaagggagagaagg

SEQ ID NO: 7094 - DNA, 24 bp, Homo sapiens
gccctgcccaggcacgtaacaaaa

SEQ ID NO: 7095 - DNA, 24 bp, Homo sapiens
cgccctgcccaggcacgtaacaaa

SEQ ID NO: 7096 - DNA, 24 bp, Homo sapiens
gcgccctgcccaggcacgtaacaa

SEQ ID NO: 7097 - DNA, 25 bp, Homo sapiens
atctgtcactgtttcccatcaaccc

SEQ ID NO: 7098 - DNA, 23 bp, Homo sapiens
cgctccttatgagaatctgatgc

SEQ ID NO: 7099 - DNA, 25 bp, Homo sapiens
accctattgtgaactgcgcctttga

SEQ ID NO: 7100 - DNA, 24 bp, Homo sapiens
gccctgcccaggcacgtaacaaaa

SEQ ID NO: 7101 - DNA, 24 bp, Homo sapiens
cgccctgcccaggcacgtaacaaa

SEQ ID NO: 7102 - DNA, 24 bp, Homo sapiens
gcgccctgcccaggcacgtaacaa

SEQ ID NO: 7103 - DNA, 24 bp, Homo sapiens
cttctctccagcagcctcgcccac

SEQ ID NO: 7104 - DNA, 24 bp, Homo sapiens
tcttctctccagcagcctcgccca

SEQ ID NO: 7105 - DNA, 24 bp, Homo sapiens
gtcttctctccagcagcctcgccc

SEQ ID NO: 7106 - DNA, 24 bp, Homo sapiens
ctggcctcagcctcccaagtagct

SEQ ID NO: 7107 - DNA, 24 bp, Homo sapiens
tctggcctcagcctcccaagtagc

SEQ ID NO: 7108 - DNA, 24 bp, Homo sapiens
ctctggcctcagcctcccaagtag

SEQ ID NO: 7109 - DNA, 24 bp, Homo sapiens
tgacatcgtgatccgcctgcctgg

SEQ ID NO: 7110 - DNA, 24 bp, Homo sapiens
aagtgctgggattacaggtgtgag

SEQ ID NO: 7111 - DNA, 24 bp, Homo sapiens
atgttagccaggatggtctcgatc

SEQ ID NO: 7112 - DNA, 24 bp, Homo sapiens
tgttccattagcggcaaccagttc

SEQ ID NO: 7113 - DNA, 24 bp, Homo sapiens
ctgttccattagcggcaaccagtt

SEQ ID NO: 7114 - DNA, 24 bp, Homo sapiens
cctgttccattagcggcaaccagt

SEQ ID NO: 7115 - DNA, 24 bp, Homo sapiens
ctggattaaaaggtgctcaggaac

SEQ ID NO: 7116 - DNA, 24 bp, Homo sapiens
gctggattaaaaggtgctcaggaa

SEQ ID NO: 7117 - DNA, 24 bp, Homo sapiens
agctggattaaaaggtgctcagga

SEQ ID NO: 7118 - DNA, 23 bp, Homo sapiens
cggactgattggcacatggcatt

SEQ ID NO: 7119 - DNA, 25 bp, Homo sapiens
tttggtgacagtgggtgaagtcctg

SEQ ID NO: 7120 - DNA, 24 bp, Homo sapiens
ttacacaagccacaccagtacctt

SEQ ID NO: 7121 - DNA, 24 bp, Homo sapiens
gatcctcctaccttggcctccgaa

SEQ ID NO: 7122 - DNA, 24 bp, Homo sapiens
gactggtctgaaactcctggcctc

SEQ ID NO: 7123 - DNA, 24 bp, Homo sapiens
tgggattacaggtgcctcaggaac

SEQ ID NO: 7124 - DNA, 24 bp, Homo sapiens
ttgggattacaggtgcctcaggaa

SEQ ID NO: 7125 - DNA, 24 bp, Homo sapiens
cttgggattacaggtgcctcagga

SEQ ID NO: 7126 - DNA, 24 bp, Homo sapiens
ggctcaccacaacctctacctcca

SEQ ID NO: 7127 - DNA, 23 bp, Homo sapiens
ctcctacctcagcctcctcagta

SEQ ID NO: 7128 - DNA, 23 bp, Homo sapiens
ggtgatcctcctgcctccgcctc

SEQ ID NO: 7129 - DNA, 24 bp, Homo sapiens
aaaaggctgggattacaggcatga

SEQ ID NO: 7130 - DNA, 24 bp, Homo sapiens
gaaaaggctgggattacaggcatg

SEQ ID NO: 7131 - DNA, 24 bp, Homo sapiens
cgaaaaggctgggattacaggcat

SEQ ID NO: 7132 - DNA, 24 bp, Homo sapiens
tgttcctgctgcctgcccagatcc

SEQ ID NO: 7133 - DNA, 24 bp, Homo sapiens
ctgttcctgctgcctgcccagatc

SEQ ID NO: 7134 - DNA, 24 bp, Homo sapiens
tctgttcctgctgcctgcccagat

SEQ ID NO: 7135 - DNA, 24 bp, Homo sapiens
ttcaagtgatcctcctgccttggc

SEQ ID NO: 7136 - DNA, 24 bp, Homo sapiens
ttgttcaagtgattctcctgcctc

SEQ ID NO: 7137 - DNA, 23 bp, Homo sapiens
atcttggctcaccacaacctccg

SEQ ID NO: 7138 - DNA, 25 bp, Homo sapiens
cacaccaccatgcccagctaatctt

SEQ ID NO: 7139 - DNA, 24 bp, Homo sapiens
ggcccgggctggcaatgccaaggc

SEQ ID NO: 7140 - DNA, 24 bp, Homo sapiens
tggcccgggctggcaatgccaagg

SEQ ID NO: 7141 - DNA, 24 bp, Homo sapiens
gtggcccgggctggcaatgccaag

SEQ ID NO: 7142 - DNA, 24 bp, Homo sapiens
ccaggtctgagatgatggaggagg

SEQ ID NO: 7143 - DNA, 24 bp, Homo sapiens
cccaggtctgagatgatggaggag

SEQ ID NO: 7144 - DNA, 24 bp, Homo sapiens
gcccaggtctgagatgatggagga

SEQ ID NO: 7145 - DNA, 24 bp, Homo sapiens
acagtttgcccaccttccctacag

SEQ ID NO: 7146 - DNA, 24 bp, Homo sapiens
cccagttagccagcaaacagagca

SEQ ID NO: 7147 - DNA, 24 bp, Homo sapiens
gactgaacaccgcacaggcaggag

SEQ ID NO: 7148 - DNA, 24 bp, Homo sapiens
cactgatgaacgatggctccaact

SEQ ID NO: 7149 - DNA, 24 bp, Homo sapiens
cctcagcactataccaacagcagc

SEQ ID NO: 7150 - DNA, 24 bp, Homo sapiens
gtaaggaaaggctggcacgaacat

SEQ ID NO: 7151 - DNA, 24 bp, Homo sapiens
ccgaatgcctcagcctccgaacat

SEQ ID NO: 7152 - DNA, 24 bp, Homo sapiens
taccttgccctccagtgacacagt

SEQ ID NO: 7153 - DNA, 24 bp, Homo sapiens
ccaacaccgcctcctgcttccacg

SEQ ID NO: 7154 - DNA, 24 bp, Homo sapiens
cgaatgcctcagcctccgaacatg

SEQ ID NO: 7155 - DNA, 24 bp, Homo sapiens
gcacacaccaacaacatgatggcc

SEQ ID NO: 7156 - DNA, 24 bp, Homo sapiens
cagttcccgtcatccagcggggcg

SEQ ID NO: 7157 - DNA, 24 bp, Homo sapiens
cagaaccagttcccgtcatccagc

SEQ ID NO: 7158 - DNA, 24 bp, Homo sapiens
ccgaatgcctcagcctccgaacat

SEQ ID NO: 7159 - DNA, 24 bp, Homo sapiens
ccaatgaaccactctgtccagatg

SEQ ID NO: 7160 - DNA, 24 bp, Homo sapiens
acctttccggcagcctgtagatcc

SEQ ID NO: 7161 - DNA, 24 bp, Homo sapiens
agcactgtatcgacaggacccaga

SEQ ID NO: 7162 - DNA, 24 bp, Homo sapiens
tacgccaggccctcatgccaaccc

SEQ ID NO: 7163 - DNA, 24 bp, Homo sapiens
gagatccagggcgagaatgtgacc

SEQ ID NO: 7164 - DNA, 24 bp, Homo sapiens
tgtgtgcgacaactgcttgaagaa

SEQ ID NO: 7165 - DNA, 24 bp, Homo sapiens
gggaaaccacttggaagaccgagt

SEQ ID NO: 7166 - DNA, 24 bp, Homo sapiens
tgtgtgcgacaactgcttgaagaa

SEQ ID NO: 7167 - DNA, 24 bp, Homo sapiens
gggaaaccacttggaagaccgagt

SEQ ID NO: 7168 - DNA, 24 bp, Homo sapiens
cagacaagacggtggaggtcaagc

SEQ ID NO: 7169 - DNA, 24 bp, Homo sapiens
gggaaaccacttggaagaccgagt

SEQ ID NO: 7170 - DNA, 24 bp, Homo sapiens
cagacaagacggtggaggtcaagc

SEQ ID NO: 7171 - DNA, 24 bp, Homo sapiens
aattgacggcgtggatgtctgctt

SEQ ID NO: 7172 - DNA, 24 bp, Homo sapiens
cttgaagaaaactggcagacctcg

SEQ ID NO: 7173 - DNA, 24 bp, Homo sapiens
gctcagacaagacggtggaggtca

SEQ ID NO: 7174 - DNA, 24 bp, Homo sapiens
gggaaaccacttggaagaccgagt

SEQ ID NO: 7175 - DNA, 24 bp, Homo sapiens
tgtgtgcgacaactgcttgaagaa

SEQ ID NO: 7176 - DNA, 23 bp, Homo sapiens
aaatcctccctgagagagccgtg

SEQ ID NO: 7177 - DNA, 23 bp, Homo sapiens
aggggagcggtttaactcggaaa

SEQ ID NO: 7178 - DNA, 23 bp, Homo sapiens
cgggacccgcctgcctcctcgcg

SEQ ID NO: 7179 - DNA, 24 bp, Homo sapiens
cccgccgccaggtccctactccta

SEQ ID NO: 7180 - DNA, 24 bp, Homo sapiens
tcccgccgccaggtccctactcct

SEQ ID NO: 7181 - DNA, 24 bp, Homo sapiens
ctcccgccgccaggtccctactcc

SEQ ID NO: 7182 - DNA, 24 bp, Homo sapiens
ctggccctgcggtgagtctgccct

SEQ ID NO: 7183 - DNA, 24 bp, Homo sapiens
cctggccctgcggtgagtctgccc

SEQ ID NO: 7184 - DNA, 24 bp, Homo sapiens
tcctggccctgcggtgagtctgcc

SEQ ID NO: 7185 - DNA, 24 bp, Homo sapiens
attatagtgaagaggtcttgctgg

SEQ ID NO: 7186 - DNA, 24 bp, Homo sapiens
cattatagtgaagaggtcttgctg

SEQ ID NO: 7187 - DNA, 24 bp, Homo sapiens
ccattatagtgaagaggtcttgct

SEQ ID NO: 7188 - DNA, 24 bp, Homo sapiens
tcatttgcggtggaccgtttgact

SEQ ID NO: 7189 - DNA, 25 bp, Homo sapiens
acattacattcctctgaacttgcca

SEQ ID NO: 7190 - DNA, 25 bp, Homo sapiens
cctaaggttctggctgaatacaagt

SEQ ID NO: 7191 - DNA, 25 bp, Homo sapiens
tgtgactattcggtatgcggagatt

SEQ ID NO: 7192 - DNA, 25 bp, Homo sapiens
cctaaggttctggctgaatacaagt

SEQ ID NO: 7193 - DNA, 25 bp, Homo sapiens
acattacattcctctgaacttgcca

SEQ ID NO: 7194 - DNA, 25 bp, Homo sapiens
agcatcacttcttggttggtctact

SEQ ID NO: 7195 - DNA, 25 bp, Homo sapiens
gcctcctgatgtgctacctgtatat

SEQ ID NO: 7196 - DNA, 24 bp, Homo sapiens
acccgacagagttctacaaggagt

SEQ ID NO: 7197 - DNA, 25 bp, Homo sapiens
gcaacaggatttccagatcagggca

SEQ ID NO: 7198 - DNA, 25 bp, Homo sapiens
gcctcctgatgtgctacctgtatat

SEQ ID NO: 7199 - DNA, 25 bp, Homo sapiens
agtataaccgcctggatcagtatga

SEQ ID NO: 7200 - DNA, 24 bp, Homo sapiens
acccgacagagttctacaaggagt

SEQ ID NO: 7201 - DNA, 25 bp, Homo sapiens
agaagatgctgggatgatggatgtc

SEQ ID NO: 7202 - DNA, 25 bp, Homo sapiens
agtgaagaggtcttgctggagttgc

SEQ ID NO: 7203 - DNA, 25 bp, Homo sapiens
tggatggcttatggaaggcagaacg

SEQ ID NO: 7204 - DNA, 25 bp, Homo sapiens
agaagatgctgggatgatggatgtc

SEQ ID NO: 7205 - DNA, 25 bp, Homo sapiens
gtgaagaggtcttgctggagttgct

SEQ ID NO: 7206 - DNA, 25 bp, Homo sapiens
tggatggcttatggaaggcagaacg

SEQ ID NO: 7207 - DNA, 24 bp, Homo sapiens
gctgtttgaccgagtgggggatgg

SEQ ID NO: 7208 - DNA, 24 bp, Homo sapiens
tacagccagtgtggggacgtgatg

SEQ ID NO: 7209 - DNA, 24 bp, Homo sapiens
gggccagaaccccaccaacgccga

SEQ ID NO: 7210 - DNA, 25 bp, Homo sapiens
tggtctgtctcttctagcctcctgc

SEQ ID NO: 7211 - DNA, 25 bp, Homo sapiens
acagtgatgatgagccattcaagcc

SEQ ID NO: 7212 - DNA, 25 bp, Homo sapiens
ggtcacctggtacacatcttggagc

SEQ ID NO: 7213 - DNA, 24 bp, Homo sapiens
ggcatcgctgggactttgtgtttc

SEQ ID NO: 7214 - DNA, 24 bp, Homo sapiens
tggcatcgctgggactttgtgttt

SEQ ID NO: 7215 - DNA, 24 bp, Homo sapiens
ctggcatcgctgggactttgtgtt

SEQ ID NO: 7216 - DNA, 24 bp, Homo sapiens
tatgtgtctaggactttgtgtttc

SEQ ID NO: 7217 - DNA, 24 bp, Homo sapiens
ttatgtgtctaggactttgtgttt

SEQ ID NO: 7218 - DNA, 24 bp, Homo sapiens
tttatgtgtctaggactttgtgtt

SEQ ID NO: 7219 - DNA, 24 bp, Homo sapiens
ccatgtcccaggactttgtgtttc

SEQ ID NO: 7220 - DNA, 24 bp, Homo sapiens
gccatgtcccaggactttgtgttt

SEQ ID NO: 7221 - DNA, 24 bp, Homo sapiens
agccatgtcccaggactttgtgtt

SEQ ID NO: 7222 - DNA, 24 bp, Homo sapiens
cctgcccgctgtgtccgacttctt

SEQ ID NO: 7223 - DNA, 24 bp, Homo sapiens
ccctgcccgctgtgtccgacttct

SEQ ID NO: 7224 - DNA, 24 bp, Homo sapiens
tccctgcccgctgtgtccgacttc

SEQ ID NO: 7225 - DNA, 24 bp, Homo sapiens
cctctaggcaggatggtgatggga

SEQ ID NO: 7226 - DNA, 24 bp, Homo sapiens
tcctctaggcaggatggtgatggg

SEQ ID NO: 7227 - DNA, 24 bp, Homo sapiens
atcctctaggcaggatggtgatgg

SEQ ID NO: 7228 - DNA, 24 bp, Homo sapiens
agaactgtagcactcaccacgagg

SEQ ID NO: 7229 - DNA, 24 bp, Homo sapiens
ggtctgcggcttcatacttgatgt

SEQ ID NO: 7230 - DNA, 24 bp, Homo sapiens
cactcctgaagccagcgacaccac

SEQ ID NO: 7231 - DNA, 25 bp, Homo sapiens
tcattttaagactcgttggaacccc

SEQ ID NO: 7232 - DNA, 23 bp, Homo sapiens
gccgagctgttgactggaagaac

SEQ ID NO: 7233 - DNA, 25 bp, Homo sapiens
ggctcctgagatcatgctgaactgg

SEQ ID NO: 7234 - DNA, 25 bp, Homo sapiens
tggctcggcacacagatgatgaaat

SEQ ID NO: 7235 - DNA, 25 bp, Homo sapiens
ggctcctgagatcatgctgaactgg

SEQ ID NO: 7236 - DNA, 25 bp, Homo sapiens
agattatgcgtctgacaggaacacc

SEQ ID NO: 7237 - DNA, 25 bp, Homo sapiens
atctcattaacaggatgccaagcca

SEQ ID NO: 7238 - DNA, 23 bp, Homo sapiens
gccgagctgttgactggaagaac

SEQ ID NO: 7239 - DNA, 25 bp, Homo sapiens
tctggcttcagtttgtgagagacct

SEQ ID NO: 7240 - DNA, 25 bp, Homo sapiens
ttgaggaccagaacacgctgacaag

SEQ ID NO: 7241 - DNA, 25 bp, Homo sapiens
tgtgacaggaatcttctctggttat

SEQ ID NO: 7242 - DNA, 25 bp, Homo sapiens
ttcctgctctagtgaggcttcttca

SEQ ID NO: 7243 - DNA, 24 bp, Homo sapiens
ttcctcatctccttcagccagtgc

SEQ ID NO: 7244 - DNA, 25 bp, Homo sapiens
gctaaccctgctgctgttgtaaatt

SEQ ID NO: 7245 - DNA, 24 bp, Homo sapiens
gtcctaccagtagctctcttccca

SEQ ID NO: 7246 - DNA, 23 bp, Homo sapiens
gctcctcttgttctcacctcctt

SEQ ID NO: 7247 - DNA, 24 bp, Homo sapiens
aataagcaccagccaacccaccag

SEQ ID NO: 7248 - DNA, 25 bp, Homo sapiens
aattcccatccacccattctacaga

SEQ ID NO: 7249 - DNA, 24 bp, Homo sapiens
tccctgcccagctccccctccggg

SEQ ID NO: 7250 - DNA, 24 bp, Homo sapiens
atccctgcccagctccccctccgg

SEQ ID NO: 7251 - DNA, 24 bp, Homo sapiens
catccctgcccagctccccctccg

SEQ ID NO: 7252 - DNA, 24 bp, Homo sapiens
ccagcgatcaggtcctttatgggc

SEQ ID NO: 7253 - DNA, 24 bp, Homo sapiens
accagcgatcaggtcctttatggg

SEQ ID NO: 7254 - DNA, 24 bp, Homo sapiens
caccagcgatcaggtcctttatgg

SEQ ID NO: 7255 - DNA, 24 bp, Homo sapiens
catggatgttggtgggtgatgcag

SEQ ID NO: 7256 - DNA, 24 bp, Homo sapiens
ccatggatgttggtgggtgatgca

SEQ ID NO: 7257 - DNA, 24 bp, Homo sapiens
cccatggatgttggtgggtgatgc

SEQ ID NO: 7258 - DNA, 24 bp, Homo sapiens
ccaacggcgaggaagtggcagtga

SEQ ID NO: 7259 - DNA, 24 bp, Homo sapiens
accaacggcgaggaagtggcagtg

SEQ ID NO: 7260 - DNA, 24 bp, Homo sapiens
caccaacggcgaggaagtggcagt

SEQ ID NO: 7261 - DNA, 24 bp, Homo sapiens
attgagcagagtcgccgagatgac

SEQ ID NO: 7262 - DNA, 24 bp, Homo sapiens
tattgagcagagtcgccgagatga

SEQ ID NO: 7263 - DNA, 24 bp, Homo sapiens
gtattgagcagagtcgccgagatg

SEQ ID NO: 7264 - DNA, 23 bp, Homo sapiens
ctggcactgcccgatatgctagc

SEQ ID NO: 7265 - DNA, 25 bp, Homo sapiens
atggatcttctgggacctagcctcg

SEQ ID NO: 7266 - DNA, 24 bp, Homo sapiens
tcaacatcaccaacggcgaggaag

SEQ ID NO: 7267 - DNA, 25 bp, Homo sapiens
agctagaatctcagaaggccaggca

SEQ ID NO: 7268 - DNA, 23 bp, Homo sapiens
ctagaccatcacagacgccgagc

SEQ ID NO: 7269 - DNA, 24 bp, Homo sapiens
ttagcggctgaagactgacactgc

SEQ ID NO: 7270 - DNA, 24 bp, Homo sapiens
ggctctctgactgactccttccca

SEQ ID NO: 7271 - DNA, 24 bp, Homo sapiens
ccttcactgagccctgcctcctgg

SEQ ID NO: 7272 - DNA, 24 bp, Homo sapiens
tccttcactgagccctgcctcctg

SEQ ID NO: 7273 - DNA, 24 bp, Homo sapiens
atccttcactgagccctgcctcct

SEQ ID NO: 7274 - DNA, 24 bp, Homo sapiens
ggcccctgctggtgaggggagaca

SEQ ID NO: 7275 - DNA, 24 bp, Homo sapiens
aggcccctgctggtgaggggagac

SEQ ID NO: 7276 - DNA, 24 bp, Homo sapiens
caggcccctgctggtgaggggaga

SEQ ID NO: 7277 - DNA, 24 bp, Homo sapiens
agctggctcaggcctcccagactg

SEQ ID NO: 7278 - DNA, 24 bp, Homo sapiens
cagctggctcaggcctcccagact

SEQ ID NO: 7279 - DNA, 24 bp, Homo sapiens
gcagctggctcaggcctcccagac

SEQ ID NO: 7280 - DNA, 24 bp, Homo sapiens
cggccgcgcaggtgagcccaggag

SEQ ID NO: 7281 - DNA, 24 bp, Homo sapiens
gcggccgcgcaggtgagcccagga

SEQ ID NO: 7282 - DNA, 24 bp, Homo sapiens
cgcggccgcgcaggtgagcccagg

SEQ ID NO: 7283 - DNA, 24 bp, Homo sapiens
aatgatgcgatctcggctcactgc

SEQ ID NO: 7284 - DNA, 23 bp, Homo sapiens
ggtgattctcctgcctcagcctc

SEQ ID NO: 7285 - DNA, 23 bp, Homo sapiens
ctcctgacctcaagtgatccgcc

SEQ ID NO: 7286 - DNA, 25 bp, Homo sapiens
aaagtgctgggattacaggcgtgag

SEQ ID NO: 7287 - DNA, 23 bp, Homo sapiens
cctccagtgatccgcccgccttg

SEQ ID NO: 7288 - DNA, 23 bp, Homo sapiens
atgttggccaggatggtctccaa

SEQ ID NO: 7289 - DNA, 24 bp, Homo sapiens
tctgcctcagcctccctagttgct

SEQ ID NO: 7290 - DNA, 24 bp, Homo sapiens
ctctgcctcagcctccctagttgc

SEQ ID NO: 7291 - DNA, 24 bp, Homo sapiens
cctctgcctcagcctccctagttg

SEQ ID NO: 7292 - DNA, 23 bp, Homo sapiens
agtgctgcgattacaggcgtgag

SEQ ID NO: 7293 - DNA, 24 bp, Homo sapiens
catctcctgaccttgtgatccgcc

SEQ ID NO: 7294 - DNA, 24 bp, Homo sapiens
aaactgctgggattacaggcgtgg

SEQ ID NO: 7295 - DNA, 24 bp, Homo sapiens
tcctgcctcagccttctgagtagc

SEQ ID NO: 7296 - DNA, 24 bp, Homo sapiens
ctcctgcctcagccttctgagtag

SEQ ID NO: 7297 - DNA, 24 bp, Homo sapiens
ctcctgcctcagccttctgagtag

SEQ ID NO: 7298 - DNA, 24 bp, Homo sapiens
agcgattcttatgcctcagcctcc

SEQ ID NO: 7299 - DNA, 23 bp, Homo sapiens
ctgcctcctcctcccaaagtgct

SEQ ID NO: 7300 - DNA, 25 bp, Homo sapiens
cagtcctttgcccattgaacggtct

SEQ ID NO: 7301 - DNA, 25 bp, Homo sapiens
aagcagttctcctacctcagcctcc

SEQ ID NO: 7302 - DNA, 24 bp, Homo sapiens
tgccaccacacccagctaagtttg

SEQ ID NO: 7303 - DNA, 25 bp, Homo sapiens
gttggtcaggctagtctcgatctcc

SEQ ID NO: 7304 - DNA, 24 bp, Homo sapiens
agttcaagcgattctcctgcctca

SEQ ID NO: 7305 - DNA, 23 bp, Homo sapiens
ctgggactacagacacccgccac

SEQ ID NO: 7306 - DNA, 23 bp, Homo sapiens
atctcgactcactgcaggctccg

SEQ ID NO: 7307 - DNA, 24 bp, Homo sapiens
cggccctgcaggtggagtctcact

SEQ ID NO: 7308 - DNA, 24 bp, Homo sapiens
ccggccctgcaggtggagtctcac

SEQ ID NO: 7309 - DNA, 24 bp, Homo sapiens
gccggccctgcaggtggagtctca

SEQ ID NO: 7310 - DNA, 24 bp, Homo sapiens
gtgttccttagatatccgccaggc

SEQ ID NO: 7311 - DNA, 24 bp, Homo sapiens
tgtgttccttagatatccgccagg

SEQ ID NO: 7312 - DNA, 24 bp, Homo sapiens
tgtgttccttagatatccgccagg

SEQ ID NO: 7313 - DNA, 24 bp, Homo sapiens
gccacatacagatatccgccaggc

SEQ ID NO: 7314 - DNA, 24 bp, Homo sapiens
tgccacatacagatatccgccagg

SEQ ID NO: 7315 - DNA, 24 bp, Homo sapiens
gtgccacatacagatatccgccag

SEQ ID NO: 7316 - DNA, 24 bp, Homo sapiens
tctgtccccaggtgctccatttct

SEQ ID NO: 7317 - DNA, 24 bp, Homo sapiens
ctctgtccccaggtgctccatttc

SEQ ID NO: 7318 - DNA, 24 bp, Homo sapiens
cctctgtccccaggtgctccattt

SEQ ID NO: 7319 - DNA, 24 bp, Homo sapiens
agcagaccattcagccaagaagca

SEQ ID NO: 7320 - DNA, 24 bp, Homo sapiens
aggtaacccagccctctccaaagg

SEQ ID NO: 7321 - DNA, 24 bp, Homo sapiens
accgaattaagccatctgctttct

SEQ ID NO: 7322 - DNA, 24 bp, Homo sapiens
ctcccctgcagctctgccccatcg

SEQ ID NO: 7323 - DNA, 24 bp, Homo sapiens
tctcccctgcagctctgccccatc

SEQ ID NO: 7324 - DNA, 24 bp, Homo sapiens
ttctcccctgcagctctgccccat

SEQ ID NO: 7325 - DNA, 23 bp, Homo sapiens
gtatgccgcctccctgggtctag

SEQ ID NO: 7326 - DNA, 23 bp, Homo sapiens
ccgcctcgcccttccagccgcac

SEQ ID NO: 7327 - DNA, 23 bp, Homo sapiens
tacagccctttccgagggatggc

SEQ ID NO: 7328 - DNA, 24 bp, Homo sapiens
gccggccgcaggtgaggtttttgt

SEQ ID NO: 7329 - DNA, 24 bp, Homo sapiens
agccggccgcaggtgaggtttttg

SEQ ID NO: 7330 - DNA, 24 bp, Homo sapiens
aagccggccgcaggtgaggttttt

SEQ ID NO: 7331 - DNA, 24 bp, Homo sapiens
tgtagtgctcagcgtgtgcttagg

SEQ ID NO: 7332 - DNA, 24 bp, Homo sapiens
ctgtagtgctcagcgtgtgcttag

SEQ ID NO: 7333 - DNA, 24 bp, Homo sapiens
tctgtagtgctcagcgtgtgctta

SEQ ID NO: 7334 - DNA, 25 bp, Homo sapiens
gaagcgacacatctctcatcagacg

SEQ ID NO: 7335 - DNA, 23 bp, Homo sapiens
tgcttcctatggcctccaccaca

SEQ ID NO: 7336 - DNA, 23 bp, Homo sapiens
cagaccccgcctcccacgagatc

SEQ ID NO: 7337 - DNA, 25 bp, Homo sapiens
cgaaccagtgcttcctaatgacaat

SEQ ID NO: 7338 - DNA, 25 bp, Homo sapiens
agaatgccctgtgaaatactgtgct

SEQ ID NO: 7339 - DNA, 25 bp, Homo sapiens
acaatctgaacactccatcttagca

SEQ ID NO: 7340 - DNA, 24 bp, Homo sapiens
tgccctgcgaggacctcccagtct

SEQ ID NO: 7341 - DNA, 24 bp, Homo sapiens
ctgccctgcgaggacctcccagtc

SEQ ID NO: 7342 - DNA, 24 bp, Homo sapiens
cctgccctgcgaggacctcccagt

SEQ ID NO: 7343 - DNA, 24 bp, Homo sapiens
ccacttccatcctgtaacgacgcc

SEQ ID NO: 7344 - DNA, 24 bp, Homo sapiens
ggagccaggaagaggagcatagaa

SEQ ID NO: 7345 - DNA, 23 bp, Homo sapiens
ctcatagtccatcagccaggagc

SEQ ID NO: 7346 - DNA, 24 bp, Homo sapiens
ccgcgttgctggcaccgctggcgc

SEQ ID NO: 7347 - DNA, 24 bp, Homo sapiens
cccgcgttgctggcaccgctggcg

SEQ ID NO: 7348 - DNA, 24 bp, Homo sapiens
tcccgcgttgctggcaccgctggc

SEQ ID NO: 7349 - DNA, 24 bp, Homo sapiens
tacatgatcagctccatcaaggaa

SEQ ID NO: 7350 - DNA, 24 bp, Homo sapiens
atacatgatcagctccatcaagga

SEQ ID NO: 7351 - DNA, 24 bp, Homo sapiens
catacatgatcagctccatcaagg

SEQ ID NO: 7352 - DNA, 25 bp, Homo sapiens
cgaccaagccaacatcacttctcag

SEQ ID NO: 7353 - DNA, 23 bp, Homo sapiens
ctccctcaccaccaatgcgacca

SEQ ID NO: 7354 - DNA, 25 bp, Homo sapiens
tccagagtgaagatagtccaagtcc

SEQ ID NO: 7355 - DNA, 25 bp, Homo sapiens
ttacacagtaacaacagtggcacca

SEQ ID NO: 7356 - DNA, 25 bp, Homo sapiens
gtctgtagtgtgcctcctccaatgc

SEQ ID NO: 7357 - DNA, 25 bp, Homo sapiens
ttcagttcagcacttaccagtacca

SEQ ID NO: 7358 - DNA, 24 bp, Homo sapiens
ccgcaagccagcttccaaacagtt

SEQ ID NO: 7359 - DNA, 24 bp, Homo sapiens
gccgcaagccagcttccaaacagt

SEQ ID NO: 7360 - DNA, 24 bp, Homo sapiens
cgccgcaagccagcttccaaacag

SEQ ID NO: 7361 - DNA, 24 bp, Homo sapiens
tcagcaagcgggagcggcagagga

SEQ ID NO: 7362 - DNA, 24 bp, Homo sapiens
ttcagcaagcgggagcggcagagg

SEQ ID NO: 7363 - DNA, 24 bp, Homo sapiens
cttcagcaagcgggagcggcagag

SEQ ID NO: 7364 - DNA, 24 bp, Homo sapiens
acactccagaggatttgcgcaagc

SEQ ID NO: 7365 - DNA, 24 bp, Homo sapiens
aacactccagaggatttgcgcaag

SEQ ID NO: 7366 - DNA, 24 bp, Homo sapiens
gaacactccagaggatttgcgcaa

SEQ ID NO: 7367 - DNA, 23 bp, Homo sapiens
ggtagcgccgctgctgaagagtt

SEQ ID NO: 7368 - DNA, 23 bp, Homo sapiens
cggcaggatgaaagtgagcagtc

SEQ ID NO: 7369 - DNA, 23 bp, Homo sapiens
agagaactcgatgccaccgcaac

SEQ ID NO: 7370 - DNA, 25 bp, Homo sapiens
tctcaatatgtctcaagatggcggc

SEQ ID NO: 7371 - DNA, 24 bp, Homo sapiens
ggactctgccaggtggatgttgtg

SEQ ID NO: 7372 - DNA, 24 bp, Homo sapiens
cacagatccagaaggcaccagacg

SEQ ID NO: 7373 - DNA, 24 bp, Homo sapiens
agagaggcggagaccttaagggaa

SEQ ID NO: 7374 - DNA, 23 bp, Homo sapiens
tcatcggccaatcactccctcca

SEQ ID NO: 7375 - DNA, 24 bp, Homo sapiens
cacagatccagaaggcaccagacg

SEQ ID NO: 7376 - DNA, 25 bp, Homo sapiens
ccgctccagcctagaagttgagttg

SEQ ID NO: 7377 - DNA, 24 bp, Homo sapiens
gaaagggcaaaccagagggcagag

SEQ ID NO: 7378 - DNA, 24 bp, Homo sapiens
ctggaggtgctgttgctggagaag

SEQ ID NO: 7379 - DNA, 25 bp, Homo sapiens
ccaggctgactatgaagaggtgaag

SEQ ID NO: 7380 - DNA, 25 bp, Homo sapiens
agcacactcaaacaactggaagaaa

SEQ ID NO: 7381 - DNA, 24 bp, Homo sapiens
cgacctgagcgagccctgtactcc

SEQ ID NO: 7382 - DNA, 24 bp, Homo sapiens
gcgacctgagcgagccctgtactc

SEQ ID NO: 7383 - DNA, 24 bp, Homo sapiens
agcgacctgagcgagccctgtact

SEQ ID NO: 7384 - DNA, 25 bp, Homo sapiens
agaagaacactccagaggatttgcg

SEQ ID NO: 7385 - DNA, 25 bp, Homo sapiens
tgaaagtgagcagtccagaaagcgg

SEQ ID NO: 7386 - DNA, 23 bp, Homo sapiens
agagaactcgatgccaccgcaac

SEQ ID NO: 7387 - DNA, 25 bp, Homo sapiens
acactgaagaaccaagccgaaacca

SEQ ID NO: 7388 - DNA, 25 bp, Homo sapiens
ttgagaaggaacagaagttacagaa

SEQ ID NO: 7389 - DNA, 23 bp, Homo sapiens
ttaaagagaaaatccgagaatat

SEQ ID NO: 7390 - DNA, 23 bp, Homo sapiens
tcatcggccaatcactccctcca

SEQ ID NO: 7391 - DNA, 24 bp, Homo sapiens
agagaggcggagaccttaagggaa

SEQ ID NO: 7392 - DNA, 25 bp, Homo sapiens
ccaggctgactatgaagaggtgaag

SEQ ID NO: 7393 - DNA, 25 bp, Homo sapiens
agcacactcaaacaactggaagaaa

SEQ ID NO: 7394 - DNA, 25 bp, Homo sapiens
ccgctccagcctagaagttgagttg

SEQ ID NO: 7395 - DNA, 25 bp, Homo sapiens
cgcaatctcggctcactacaacctc

SEQ ID NO: 7396 - DNA, 25 bp, Homo sapiens
agtgattctcatgcttcagcctcct

SEQ ID NO: 7397 - DNA, 23 bp, Homo sapiens
gtctcactccatcacccaggctg

SEQ ID NO: 7398 - DNA, 23 bp, Homo sapiens
tcctcctgctctttgctccgtga

SEQ ID NO: 7399 - DNA, 25 bp, Homo sapiens
accagcccaagaaacatctcaccaa

SEQ ID NO: 7400 - DNA, 24 bp, Homo sapiens
catgaaatttggtgccgtgactcg

SEQ ID NO: 7401 - DNA, 24 bp, Homo sapiens
attgctcacacaaagcctgtttgg

SEQ ID NO: 7402 - DNA, 24 bp, Homo sapiens
tattgctcacacaaagcctgtttg

SEQ ID NO: 7403 - DNA, 24 bp, Homo sapiens
ttattgctcacacaaagcctgttt

SEQ ID NO: 7404 - DNA, 25 bp, Homo sapiens
aatcggactgttcaactcacctggc

SEQ ID NO: 7405 - DNA, 24 bp, Homo sapiens
ttagcggctgaagactgacactgc

SEQ ID NO: 7406 - DNA, 23 bp, Homo sapiens
cctagaccatcacgcacgccgag

SEQ ID NO: 7407 - DNA, 24 bp, Homo sapiens
tcctttcacagagcttgtcggtta

SEQ ID NO: 7408 - DNA, 24 bp, Homo sapiens
ttcctttcacagagcttgtcggtt

SEQ ID NO: 7409 - DNA, 24 bp, Homo sapiens
cttcctttcacagagcttgtcggt

SEQ ID NO: 7410 - DNA, 24 bp, Homo sapiens
gctgaggaggacttgacatttgag

SEQ ID NO: 7411 - DNA, 24 bp, Homo sapiens
ggctgaggaggacttgacatttga

SEQ ID NO: 7412 - DNA, 24 bp, Homo sapiens
gggctgaggaggacttgacatttg

SEQ ID NO: 7413 - DNA, 25 bp, Homo sapiens
gtgtggtgaaggactccatcaactt

SEQ ID NO: 7414 - DNA, 24 bp, Homo sapiens
gttccagtgcggtaagagaaaatg

SEQ ID NO: 7415 - DNA, 24 bp, Homo sapiens
ggttccagtgcggtaagagaaaat

SEQ ID NO: 7416 - DNA, 24 bp, Homo sapiens
gggttccagtgcggtaagagaaaa

SEQ ID NO: 7417 - DNA, 24 bp, Homo sapiens
gctgattctcttgccagtctgtcg

SEQ ID NO: 7418 - DNA, 24 bp, Homo sapiens
tgcagcctgcctgaatttcaactg

SEQ ID NO: 7419 - DNA, 24 bp, Homo sapiens
ggctgttcaatgcttgtggctgtg

SEQ ID NO: 7420 - DNA, 24 bp, Homo sapiens
tcaagtgcccaaaggtgtccaagc

SEQ ID NO: 7421 - DNA, 24 bp, Homo sapiens
tggcgatctcaacagaaggtggtc

SEQ ID NO: 7422 - DNA, 23 bp, Homo sapiens
gactccctgtctttgcggtttgg

SEQ ID NO: 7423 - DNA, 24 bp, Homo sapiens
atgagaaaccacagaattgctagt

SEQ ID NO: 7424 - DNA, 25 bp, Homo sapiens
tctggctcgtcttatttgctcttca

SEQ ID NO: 7425 - DNA, 25 bp, Homo sapiens
tctgacaagtattgcggaatgctgc

SEQ ID NO: 7426 - DNA, 25 bp, Homo sapiens
tttgggtttggtcttcacggtttct

SEQ ID NO: 7427 - DNA, 23 bp, Homo sapiens
ttctcctggactccttgatgccg

SEQ ID NO: 7428 - DNA, 24 bp, Homo sapiens
gcgattctcctgcttcagccttct

SEQ ID NO: 7429 - DNA, 24 bp, Homo sapiens
gaacactctcaagacctgctccgt

SEQ ID NO: 7430 - DNA, 24 bp, Homo sapiens
ttctcctccagctcacaggaagta

SEQ ID NO: 7431 - DNA, 24 bp, Homo sapiens
tttctcctccagctcacaggaagt

SEQ ID NO: 7432 - DNA, 24 bp, Homo sapiens
ctttctcctccagctcacaggaag

SEQ ID NO: 7433 - DNA, 24 bp, Homo sapiens
atgggatacaggatgaccatgaaa

SEQ ID NO: 7434 - DNA, 24 bp, Homo sapiens
gatgggatacaggatgaccatgaa

SEQ ID NO: 7435 - DNA, 24 bp, Homo sapiens
ggatgggatacaggatgaccatga

SEQ ID NO: 7436 - DNA, 23 bp, Homo sapiens
ggctgacaatccccttggcagat

SEQ ID NO: 7437 - DNA, 24 bp, Homo sapiens
ttgaagattggctctgttgccatg

SEQ ID NO: 7438 - DNA, 24 bp, Homo sapiens
aatcaggcagcaaaagaagacact

SEQ ID NO: 7439 - DNA, 24 bp, Homo sapiens
aagaccttcatagcaccaagtggc

SEQ ID NO: 7440 - DNA, 25 bp, Homo sapiens
gccttcacaatccaagttccacaat

SEQ ID NO: 7441 - DNA, 25 bp, Homo sapiens
agcctcagaaacgaacaagtagaca

SEQ ID NO: 7442 - DNA, 25 bp, Homo sapiens
cattgtcattcaggtgccatcttca

SEQ ID NO: 7443 - DNA, 25 bp, Homo sapiens
aaggagatgaagactggtcaagaga

SEQ ID NO: 7444 - DNA, 25 bp, Homo sapiens
aagtcgttcagcattacattggtca

SEQ ID NO: 7445 - DNA, 25 bp, Homo sapiens
gcccgtgatcttctaccaataaagc

SEQ ID NO: 7446 - DNA, 25 bp, Homo sapiens
gcaggctggctatatcacagaagat

SEQ ID NO: 7447 - DNA, 25 bp, Homo sapiens
gccctcaactctctggatcactaga

SEQ ID NO: 7448 - DNA, 25 bp, Homo sapiens
attcagcaacaaagcaaacctctgg

SEQ ID NO: 7449 - DNA, 25 bp, Homo sapiens
acagaagcagattgggttcctctcg

SEQ ID NO: 7450 - DNA, 25 bp, Homo sapiens
tgttcactcattccaggaaggtgct

SEQ ID NO: 7451 - DNA, 24 bp, Homo sapiens
cgaactcctgacctgaagtgatgc

SEQ ID NO: 7452 - DNA, 24 bp, Homo sapiens
ccaaggtgctggaattacaggcgt

SEQ ID NO: 7453 - DNA, 24 bp, Homo sapiens
ccgcgcccggcctagaggattctt

SEQ ID NO: 7454 - DNA, 25 bp, Homo sapiens
agtgattctctagccttagcctcct

SEQ ID NO: 7455 - DNA, 23 bp, Homo sapiens
caggctggagtgcagtggcgtga

SEQ ID NO: 7456 - DNA, 23 bp, Homo sapiens
ctcactgcaacctttgcctcctg

SEQ ID NO: 7457 - DNA, 23 bp, Homo sapiens
agtgctggaattactggcgtgag

SEQ ID NO: 7458 - DNA, 23 bp, Homo sapiens
cacgtgatcctcccgtctccgcc

SEQ ID NO: 7459 - DNA, 23 bp, Homo sapiens
aggctggcctgagtattctagtt

SEQ ID NO: 7460 - DNA, 25 bp, Homo sapiens
ggtctcactctgtcactctgttgcc

SEQ ID NO: 7461 - DNA, 23 bp, Homo sapiens
tcactgtagcctctgcctccctg

SEQ ID NO: 7462 - DNA, 25 bp, Homo sapiens
gctattctcccacctcatcctcccg

SEQ ID NO: 7463 - DNA, 24 bp, Homo sapiens
ttggctaggctggtcttgaactcc

SEQ ID NO: 7464 - DNA, 24 bp, Homo sapiens
agatggagtctcgctctgttgccc

SEQ ID NO: 7465 - DNA, 24 bp, Homo sapiens
ctctgcctcagcctcccaagtagt

SEQ ID NO: 7466 - DNA, 25 bp, Homo sapiens
cacatcctgcctccatcttccatct

SEQ ID NO: 7467 - DNA, 23 bp, Homo sapiens
atgagtgtgactgtgggctgctc

SEQ ID NO: 7468 - DNA, 23 bp, Homo sapiens
tccacgatgactgcctgcaagcg

SEQ ID NO: 7469 - DNA, 25 bp, Homo sapiens
gcaaattgacggagaaccctggatg

SEQ ID NO: 7470 - DNA, 24 bp, Homo sapiens
tcacccacaagaaccagatgccca

SEQ ID NO: 7471 - DNA, 23 bp, Homo sapiens
ttgaacccacctccctgtccctg

SEQ ID NO: 7472 - DNA, 23 bp, Homo sapiens
gttcacaccattctcctgcctca

SEQ ID NO: 7473 - DNA, 23 bp, Homo sapiens
gaccttgtgatctgccagcctcg

SEQ ID NO: 7474 - DNA, 23 bp, Homo sapiens
ccgccaccatgcccagctaattt

SEQ ID NO: 7475 - DNA, 23 bp, Homo sapiens
gcccgcctcagccttccaaagta

SEQ ID NO: 7476 - DNA, 23 bp, Homo sapiens
ggtcaggctggtcttgaactccc

SEQ ID NO: 7477 - DNA, 24 bp, Homo sapiens
atgatccacccgactcagcctacc

SEQ ID NO: 7478 - DNA, 24 bp, Homo sapiens
ataacctccaggtggctgtgaaaa

SEQ ID NO: 7479 - DNA, 24 bp, Homo sapiens
aataacctccaggtggctgtgaaa

SEQ ID NO: 7480 - DNA, 24 bp, Homo sapiens
gaataacctccaggtggctgtgaa

SEQ ID NO: 7481 - DNA, 24 bp, Homo sapiens
agtctgcgtggcaaaactccatga

SEQ ID NO: 7482 - DNA, 24 bp, Homo sapiens
cagtctgcgtggcaaaactccatg

SEQ ID NO: 7483 - DNA, 24 bp, Homo sapiens
gcagtctgcgtggcaaaactccat

SEQ ID NO: 7484 - DNA, 24 bp, Homo sapiens
tgtcgccctgaggaacatcaactt

SEQ ID NO: 7485 - DNA, 25 bp, Homo sapiens
ccctccacttgtcactttgctgtct

SEQ ID NO: 7486 - DNA, 24 bp, Homo sapiens
gagcatctgtgagcgggtaactcc

SEQ ID NO: 7487 - DNA, 23 bp, Homo sapiens
tagcaatcagcgagactccgtgg

SEQ ID NO: 7488 - DNA, 24 bp, Homo sapiens
gaggcaggagaatggcgtgaatcg

SEQ ID NO: 7489 - DNA, 25 bp, Homo sapiens
ggtgacagagcgagactccgtatca

SEQ ID NO: 7490 - DNA, 23 bp, Homo sapiens
atgccattctcctgcctcagcct

SEQ ID NO: 7491 - DNA, 24 bp, Homo sapiens
caaagtgctgggattacaggcatg

SEQ ID NO: 7492 - DNA, 24 bp, Homo sapiens
ccaaagtgctgggattacaggcat

SEQ ID NO: 7493 - DNA, 24 bp, Homo sapiens
cccaaagtgctgggattacaggca

SEQ ID NO: 7494 - DNA, 24 bp, Homo sapiens
tcaataaaacggcgtgcaatggaa

SEQ ID NO: 7495 - DNA, 24 bp, Homo sapiens
ctcaataaaacggcgtgcaatgga

SEQ ID NO: 7496 - DNA, 24 bp, Homo sapiens
tctcaataaaacggcgtgcaatgg

SEQ ID NO: 7497 - DNA, 24 bp, Homo sapiens
tattagcacaggttgccactaata

SEQ ID NO: 7498 - DNA, 24 bp, Homo sapiens
atattagcacaggttgccactaat

SEQ ID NO: 7499 - DNA, 24 bp, Homo sapiens
tatattagcacaggttgccactaa

SEQ ID NO: 7500 - DNA, 23 bp, Homo sapiens
cgggacggttcggttgattgtgt

SEQ ID NO: 7501 - DNA, 25 bp, Homo sapiens
gttaggactcggtgtaggagatcca

SEQ ID NO: 7502 - DNA, 24 bp, Homo sapiens
ttctcccggtcttcctgattgcct

SEQ ID NO: 7503 - DNA, 24 bp, Homo sapiens
acttcagcatcggtgaggttggtc

SEQ ID NO: 7504 - DNA, 24 bp, Homo sapiens
atgaagtggcttgcttggacatca

SEQ ID NO: 7505 - DNA, 24 bp, Homo sapiens
cggacatctcggctcgtatcttga

SEQ ID NO: 7506 - DNA, 24 bp, Homo sapiens
agagctgaaaggatgggtctggca

SEQ ID NO: 7507 - DNA, 24 bp, Homo sapiens
aagagctgaaaggatgggtctggc

SEQ ID NO: 7508 - DNA, 24 bp, Homo sapiens
gaagagctgaaaggatgggtctgg

SEQ ID NO: 7509 - DNA, 24 bp, Homo sapiens
gcttctgataattggaggtgttgc

SEQ ID NO: 7510 - DNA, 24 bp, Homo sapiens
acaaagtttctccccaatgctccg

SEQ ID NO: 7511 - DNA, 24 bp, Homo sapiens
attgtcaaatcacagcactcaggt

SEQ ID NO: 7512 - DNA, 24 bp, Homo sapiens
ggcaatttccctggtggcaacaga

SEQ ID NO: 7513 - DNA, 24 bp, Homo sapiens
ttcagagacttacaggtgcttgcc

SEQ ID NO: 7514 - DNA, 24 bp, Homo sapiens
taatggcactcagcagcaagcaca

SEQ ID NO: 7515 - DNA, 24 bp, Homo sapiens
attaaacctggtgatgactggaaa

SEQ ID NO: 7516 - DNA, 24 bp, Homo sapiens
ccttacttgaacggctagacctga

SEQ ID NO: 7517 - DNA, 24 bp, Homo sapiens
agaacttgctctacaggtcagtca

SEQ ID NO: 7518 - DNA, 24 bp, Homo sapiens
acgagatgacataatgaggcttga

SEQ ID NO: 7519 - DNA, 24 bp, Homo sapiens
tggcctcgttgattgacgtgagtg

SEQ ID NO: 7520 - DNA, 24 bp, Homo sapiens
gtggcctcgttgattgacgtgagt

SEQ ID NO: 7521 - DNA, 24 bp, Homo sapiens
agtggcctcgttgattgacgtgag

SEQ ID NO: 7522 - DNA, 24 bp, Homo sapiens
agaggtcggaggagatcacttgct

SEQ ID NO: 7523 - DNA, 24 bp, Homo sapiens
ttcacaggaacactccactgcatg

SEQ ID NO: 7524 - DNA, 24 bp, Homo sapiens
cgggatatctaccacatcagcagg

SEQ ID NO: 7525 - DNA, 24 bp, Homo sapiens
tgcctgtaccaagaatgttgactt

SEQ ID NO: 7526 - DNA, 24 bp, Homo sapiens
cctcacccgttccacatcaatgct

SEQ ID NO: 7527 - DNA, 24 bp, Homo sapiens
tggttctctgaatcagtggctggt

SEQ ID NO: 7528 - DNA, 24 bp, Homo sapiens
gcattggttcagaagtaagtgaag

SEQ ID NO: 7529 - DNA, 24 bp, Homo sapiens
ggcattggttcagaagtaagtgaa

SEQ ID NO: 7530 - DNA, 24 bp, Homo sapiens
tggcattggttcagaagtaagtga

SEQ ID NO: 7531 - DNA, 25 bp, Homo sapiens
acagaaatggatgggattgaacagc

SEQ ID NO: 7532 - DNA, 25 bp, Homo sapiens
gaccattttggcagctactaaccgt

SEQ ID NO: 7533 - DNA, 25 bp, Homo sapiens
tgtagccgatcgtgttttggctcag

SEQ ID NO: 7534 - DNA, 24 bp, Homo sapiens
accatgcccagccgatttattttg

SEQ ID NO: 7535 - DNA, 24 bp, Homo sapiens
caccatgcccagccgatttatttt

SEQ ID NO: 7536 - DNA, 24 bp, Homo sapiens
ccaccatgcccagccgatttattt

SEQ ID NO: 7537 - DNA, 25 bp, Homo sapiens
ttgctgcctcaaggtgaagatgtgg

SEQ ID NO: 7538 - DNA, 25 bp, Homo sapiens
tgtgctgctagagaggtctttgaag

SEQ ID NO: 7539 - DNA, 24 bp, Homo sapiens
gaatcaatgaccagcttgctcgtt

SEQ ID NO: 7540 - DNA, 23 bp, Homo sapiens
ctgtcctcctgccttggtctcct

SEQ ID NO: 7541 - DNA, 24 bp, Homo sapiens
cgcctcccgagttcacaccattct

SEQ ID NO: 7542 - DNA, 24 bp, Homo sapiens
gatcagtggtgcaatctcggctca

SEQ ID NO: 7543 - DNA, 24 bp, Homo sapiens
agcctgccaagtagctgggactac

SEQ ID NO: 7544 - DNA, 24 bp, Homo sapiens
cctgacctcaggtaatctgcctac

SEQ ID NO: 7545 - DNA, 24 bp, Homo sapiens
tcctgacctcaggtaatctgccta

SEQ ID NO: 7546 - DNA, 24 bp, Homo sapiens
ctcctgacctcaggtaatctgcct

SEQ ID NO: 7547 - DNA, 23 bp, Homo sapiens
ggactacaggtgcccgccatcat

SEQ ID NO: 7548 - DNA, 23 bp, Homo sapiens
gcaacctctgcctcctgtgttca

SEQ ID NO: 7549 - DNA, 23 bp, Homo sapiens
ttctcctgcctcaccctcctgag

SEQ ID NO: 7550 - DNA, 24 bp, Homo sapiens
tctcctgacctcgtgatctgcctg

SEQ ID NO: 7551 - DNA, 24 bp, Homo sapiens
atgccattctcctgcttcagcctc

SEQ ID NO: 7552 - DNA, 24 bp, Homo sapiens
gctaggactacaggtgcccgccac

SEQ ID NO: 7553 - DNA, 24 bp, Homo sapiens
tctcctgacctcgtgatctgcctg

SEQ ID NO: 7554 - DNA, 24 bp, Homo sapiens
atgccattctcctgcttcagcctc

SEQ ID NO: 7555 - DNA, 24 bp, Homo sapiens
gcagtggcatgatctcggctcacc

SEQ ID NO: 7556 - DNA, 24 bp, Homo sapiens
tctctctccaggtggccatcaggc

SEQ ID NO: 7557 - DNA, 24 bp, Homo sapiens
gtctctctccaggtggccatcagg

SEQ ID NO: 7558 - DNA, 24 bp, Homo sapiens
ggtctctctccaggtggccatcag

SEQ ID NO: 7559 - DNA, 24 bp, Homo sapiens
cactgcatgttctcactcttttga

SEQ ID NO: 7560 - DNA, 24 bp, Homo sapiens
acactgcatgttctcactcttttg

SEQ ID NO: 7561 - DNA, 24 bp, Homo sapiens
aacactgcatgttctcactctttt

SEQ ID NO: 7562 - DNA, 24 bp, Homo sapiens
caattctcctgcctcagcctcctg

SEQ ID NO: 7563 - DNA, 24 bp, Homo sapiens
tgaactcctgacctcgtgatccgc

SEQ ID NO: 7564 - DNA, 24 bp, Homo sapiens
tttcctaccgcagcctcccgtgta

SEQ ID NO: 7565 - DNA, 23 bp, Homo sapiens
tgctccaagaccttcgccaacag

SEQ ID NO: 7566 - DNA, 23 bp, Homo sapiens
ctctcccaccttcagcagcacac

SEQ ID NO: 7567 - DNA, 24 bp, Homo sapiens
tcccacagacggcaacacaacaaa

SEQ ID NO: 7568 - DNA, 23 bp, Homo sapiens
cagcacatctacctctcggctcg

SEQ ID NO: 7569 - DNA, 24 bp, Homo sapiens
gccctatacacccatctccagcga

SEQ ID NO: 7570 - DNA, 23 bp, Homo sapiens
gacacccatcccaagtttcccgc

SEQ ID NO: 7571 - DNA, 24 bp, Homo sapiens
aggactgcttctggacaaaggtga

SEQ ID NO: 7572 - DNA, 24 bp, Homo sapiens
accgctttgagaacaatgaacttt

SEQ ID NO: 7573 - DNA, 24 bp, Homo sapiens
acttacccttaccttctctgccca

SEQ ID NO: 7574 - DNA, 24 bp, Homo sapiens
taccactcctcctcctcctcctcc

SEQ ID NO: 7575 - DNA, 24 bp, Homo sapiens
aagaaatggcttccctctctgcgg

SEQ ID NO: 7576 - DNA, 24 bp, Homo sapiens
gttgccaagctgacaaaggaactg

SEQ ID NO: 7577 - DNA, 25 bp, Homo sapiens
cccaaacaacccaacatgatgactg

SEQ ID NO: 7578 - DNA, 25 bp, Homo sapiens
gcattgttggagaagagaacattct

SEQ ID NO: 7579 - DNA, 25 bp, Homo sapiens
acagcagcagaaagaaataacaggg

SEQ ID NO: 7580 - DNA, 25 bp, Homo sapiens
ggtcttggactcttattggatgagc

SEQ ID NO: 7581 - DNA, 25 bp, Homo sapiens
atttctgccactgccaaatctggtg

SEQ ID NO: 7582 - DNA, 25 bp, Homo sapiens
tgatggaggacatgaaccttaacga

SEQ ID NO: 7583 - DNA, 25 bp, Homo sapiens
gcccttgtcacttctccttatgagc

SEQ ID NO: 7584 - DNA, 25 bp, Homo sapiens
acagcagcagaaagaaataacaggg

SEQ ID NO: 7585 - DNA, 25 bp, Homo sapiens
gcattgttggagaagagaacattct

SEQ ID NO: 7586 - DNA, 25 bp, Homo sapiens
tgaatatgatgacctctgtgagcct

SEQ ID NO: 7587 - DNA, 25 bp, Homo sapiens
gcagaagatactcaacgaattagca

SEQ ID NO: 7588 - DNA, 25 bp, Homo sapiens
aatgaagacatgctgagtgaggctt

SEQ ID NO: 7589 - DNA, 24 bp, Homo sapiens
aatggtggcaggggagtcaggcct

SEQ ID NO: 7590 - DNA, 24 bp, Homo sapiens
taatggtggcaggggagtcaggcc

SEQ ID NO: 7591 - DNA, 24 bp, Homo sapiens
ctaatggtggcaggggagtcaggc

SEQ ID NO: 7592 - DNA, 24 bp, Homo sapiens
acagcctcttcctcaccaacctct

SEQ ID NO: 7593 - DNA, 24 bp, Homo sapiens
gccagtgctcgcttgacacagacc

SEQ ID NO: 7594 - DNA, 24 bp, Homo sapiens
tggactgctctgactgctggcttc

SEQ ID NO: 7595 - DNA, 24 bp, Homo sapiens
gtttttgacttccagaaagcttac

SEQ ID NO: 7596 - DNA, 24 bp, Homo sapiens
agttctgttgttcccaagtcaaac

SEQ ID NO: 7597 - DNA, 24 bp, Homo sapiens
gattgtgcttagaggacaagaaat

SEQ ID NO: 7598 - DNA, 23 bp, Homo sapiens
ccaggctggtctcgacctcctcg

SEQ ID NO: 7599 - DNA, 23 bp, Homo sapiens
atgatcctcctgcatcagtctcc

SEQ ID NO: 7600 - DNA, 24 bp, Homo sapiens
gccctgctgcaatggagtttgacg

SEQ ID NO: 7601 - DNA, 24 bp, Homo sapiens
agccctgctgcaatggagtttgac

SEQ ID NO: 7602 - DNA, 24 bp, Homo sapiens
aagccctgctgcaatggagtttga

SEQ ID NO: 7603 - DNA, 24 bp, Homo sapiens
tgtggatggagaggaagtggtgaa

SEQ ID NO: 7604 - DNA, 24 bp, Homo sapiens
tcaacaccgttctggaggcttaca

SEQ ID NO: 7605 - DNA, 24 bp, Homo sapiens
aatgtgagccaatcctaagaacgc

SEQ ID NO: 7606 - DNA, 24 bp, Homo sapiens
agaatgtccagatgccctccaaaa

SEQ ID NO: 7607 - DNA, 24 bp, Homo sapiens
acaattcagctttggataaaatgc

SEQ ID NO: 7608 - DNA, 24 bp, Homo sapiens
ttgctgtcctgtggagacctccag

SEQ ID NO: 7609 - DNA, 24 bp, Homo sapiens
cttgctgtcctgtggagacctcca

SEQ ID NO: 7610 - DNA, 24 bp, Homo sapiens
ccttgctgtcctgtggagacctcc

SEQ ID NO: 7611 - DNA, 24 bp, Homo sapiens
aggtggagatcctgaaggagcaga

SEQ ID NO: 7612 - DNA, 24 bp, Homo sapiens
gaggtggagatcctgaaggagcag

SEQ ID NO: 7613 - DNA, 24 bp, Homo sapiens
ggaggtggagatcctgaaggagca

SEQ ID NO: 7614 - DNA, 24 bp, Homo sapiens
ctggacaacagtgcctccggagcc

SEQ ID NO: 7615 - DNA, 24 bp, Homo sapiens
gctggacaacagtgcctccggagc

SEQ ID NO: 7616 - DNA, 24 bp, Homo sapiens
agctggacaacagtgcctccggag

SEQ ID NO: 7617 - DNA, 24 bp, Homo sapiens
tgatgtaggagctggtgtcataga

SEQ ID NO: 7618 - DNA, 24 bp, Homo sapiens
ttgatgtaggagctggtgtcatag

SEQ ID NO: 7619 - DNA, 24 bp, Homo sapiens
attgatgtaggagctggtgtcata

SEQ ID NO: 7620 - DNA, 24 bp, Homo sapiens
cctccctgcaggcgagcccatccg

SEQ ID NO: 7621 - DNA, 24 bp, Homo sapiens
tcctccctgcaggcgagcccatcc

SEQ ID NO: 7622 - DNA, 24 bp, Homo sapiens
atcctccctgcaggcgagcccatc

SEQ ID NO: 7623 - DNA, 24 bp, Homo sapiens
cacaaaccggggcccatcaccctg

SEQ ID NO: 7624 - DNA, 24 bp, Homo sapiens
gcacaaaccggggcccatcaccct

SEQ ID NO: 7625 - DNA, 24 bp, Homo sapiens
tgcacaaaccggggcccatcaccc

SEQ ID NO: 7626 - DNA, 24 bp, Homo sapiens
gtcaagctcaggtggctcatcggg

SEQ ID NO: 7627 - DNA, 24 bp, Homo sapiens
cgtcaagctcaggtggctcatcgg

SEQ ID NO: 7628 - DNA, 24 bp, Homo sapiens
tcgtcaagctcaggtggctcatcg

SEQ ID NO: 7629 - DNA, 24 bp, Homo sapiens
ctacagcaatgggataaggacgga

SEQ ID NO: 7630 - DNA, 24 bp, Homo sapiens
tctacagcaatgggataaggacgg

SEQ ID NO: 7631 - DNA, 24 bp, Homo sapiens
ctctacagcaatgggataaggacg

SEQ ID NO: 7632 - DNA, 24 bp, Homo sapiens
tctggaacatggtaggcgaatcat

SEQ ID NO: 7633 - DNA, 24 bp, Homo sapiens
atctggaacatggtaggcgaatca

SEQ ID NO: 7634 - DNA, 24 bp, Homo sapiens
tatctggaacatggtaggcgaatc

SEQ ID NO: 7635 - DNA, 24 bp, Homo sapiens
ctttaagcctcctgagtagctggg

SEQ ID NO: 7636 - DNA, 24 bp, Homo sapiens
actttaagcctcctgagtagctgg

SEQ ID NO: 7637 - DNA, 24 bp, Homo sapiens
gactttaagcctcctgagtagctg

SEQ ID NO: 7638 - DNA, 23 bp, Homo sapiens
ggcagtggcacgatctcggctca

SEQ ID NO: 7639 - DNA, 25 bp, Homo sapiens
cctctgcctcccaggttcaatcaat

SEQ ID NO: 7640 - DNA, 25 bp, Homo sapiens
ttcaacctcccgagtagctggaact

SEQ ID NO: 7641 - DNA, 24 bp, Homo sapiens
ttgaggagcacgtgcagagtgtcg

SEQ ID NO: 7642 - DNA, 24 bp, Homo sapiens
tttgaggagcacgtgcagagtgtc

SEQ ID NO: 7643 - DNA, 24 bp, Homo sapiens
gtttgaggagcacgtgcagagtgt

SEQ ID NO: 7644 - DNA, 25 bp, Homo sapiens
gcagctttcaacaagatctgaagcc

SEQ ID NO: 7645 - DNA, 23 bp, Homo sapiens
cacgattaaagactgagaccggc

SEQ ID NO: 7646 - DNA, 23 bp, Homo sapiens
gtgtacgtgcgcgcgtgcgtgag

SEQ ID NO: 7647 - DNA, 24 bp, Homo sapiens
tggagatccagtgtccagagcagg

SEQ ID NO: 7648 - DNA, 24 bp, Homo sapiens
gtggagatccagtgtccagagcag

SEQ ID NO: 7649 - DNA, 24 bp, Homo sapiens
tgtggagatccagtgtccagagca

SEQ ID NO: 7650 - DNA, 24 bp, Homo sapiens
ccttcgacaacagcagccgcccca

SEQ ID NO: 7651 - DNA, 24 bp, Homo sapiens
cccttcgacaacagcagccgcccc

SEQ ID NO: 7652 - DNA, 24 bp, Homo sapiens
ccccttcgacaacagcagccgccc

SEQ ID NO: 7653 - DNA, 24 bp, Homo sapiens
ggattgcaacgaggagaagatgac

SEQ ID NO: 7654 - DNA, 24 bp, Homo sapiens
aagtgattctcttgcctcagcctc

SEQ ID NO: 7655 - DNA, 24 bp, Homo sapiens
ggctcactgcaacctctacctcct

SEQ ID NO: 7656 - DNA, 24 bp, Homo sapiens
gagattgccaaccgtgagaaacag

SEQ ID NO: 7657 - DNA, 24 bp, Homo sapiens
agagattgccaaccgtgagaaaca

SEQ ID NO: 7658 - DNA, 24 bp, Homo sapiens
aagagattgccaaccgtgagaaac

SEQ ID NO: 7659 - DNA, 24 bp, Homo sapiens
gacaaagagaggtccaccgtttat

SEQ ID NO: 7660 - DNA, 24 bp, Homo sapiens
ggacaaagagaggtccaccgttta

SEQ ID NO: 7661 - DNA, 24 bp, Homo sapiens
gggacaaagagaggtccaccgttt

SEQ ID NO: 7662 - DNA, 24 bp, Homo sapiens
gagccgttagcatccatctcctcc

SEQ ID NO: 7663 - DNA, 24 bp, Homo sapiens
ggtccaagaaagaagatgtgccct

SEQ ID NO: 7664 - DNA, 24 bp, Homo sapiens
gccaggtctcacagaatcacatcg

SEQ ID NO: 7665 - DNA, 24 bp, Homo sapiens
tactagagcaaatcagaggcgtcg

SEQ ID NO: 7666 - DNA, 24 bp, Homo sapiens
ccattgaggacagcagggacaagc

SEQ ID NO: 7667 - DNA, 24 bp, Homo sapiens
ctttcatcggcaccaaccctgacc

SEQ ID NO: 7668 - DNA, 24 bp, Homo sapiens
ccagacagcaataatgtagccagc

SEQ ID NO: 7669 - DNA, 24 bp, Homo sapiens
gggatgctgaaaacctttgggctt

SEQ ID NO: 7670 - DNA, 24 bp, Homo sapiens
ggaactgctctgccaaaatttgcc

SEQ ID NO: 7671 - DNA, 24 bp, Homo sapiens
tgacaagagcaagtacagcaaggc

SEQ ID NO: 7672 - DNA, 24 bp, Homo sapiens
ccaaggacaaggctgtgctcaaca

SEQ ID NO: 7673 - DNA, 24 bp, Homo sapiens
tgagaagaagccaactgtgaagcc

SEQ ID NO: 7674 - DNA, 24 bp, Homo sapiens
aagcagcaaaggttcaaaagctgt

SEQ ID NO: 7675 - DNA, 24 bp, Homo sapiens
aaagcagcaaaggttcaaaagctg

SEQ ID NO: 7676 - DNA, 24 bp, Homo sapiens
gaaagcagcaaaggttcaaaagct

SEQ ID NO: 7677 - DNA, 24 bp, Homo sapiens
gagtattaaaggtgggccaggaga

SEQ ID NO: 7678 - DNA, 24 bp, Homo sapiens
ggagtattaaaggtgggccaggag

SEQ ID NO: 7679 - DNA, 24 bp, Homo sapiens
aggagtattaaaggtgggccagga

SEQ ID NO: 7680 - DNA, 24 bp, Homo sapiens
cccaagttgccctcagcctcccga

SEQ ID NO: 7681 - DNA, 24 bp, Homo sapiens
acccaagttgccctcagcctcccg

SEQ ID NO: 7682 - DNA, 24 bp, Homo sapiens
gacccaagttgccctcagcctccc

SEQ ID NO: 7683 - DNA, 24 bp, Homo sapiens
ctggagttcatactgtcaggttca

SEQ ID NO: 7684 - DNA, 24 bp, Homo sapiens
ctcatgggaaatccacagtcgtca

SEQ ID NO: 7685 - DNA, 24 bp, Homo sapiens
agaaagaaatattacaatcaagct

SEQ ID NO: 7686 - DNA, 23 bp, Homo sapiens
ggaggaggagtggaagcaaggaa

SEQ ID NO: 7687 - DNA, 23 bp, Homo sapiens
acaatgtggtcttggctccagtg

SEQ ID NO: 7688 - DNA, 23 bp, Homo sapiens
ggaccgatctatagcaggaattc

SEQ ID NO: 7689 - DNA, 24 bp, Homo sapiens
ttcagcctcccaaagtgctggaat

SEQ ID NO: 7690 - DNA, 24 bp, Homo sapiens
caagtgatcctcccacttcagcct

SEQ ID NO: 7691 - DNA, 23 bp, Homo sapiens
tgcccatgtctaccctgctggat

SEQ ID NO: 7692 - DNA, 23 bp, Homo sapiens
gatctcctacccagcctcccagg

SEQ ID NO: 7693 - DNA, 23 bp, Homo sapiens
cgttgtcccgacacagcagtacc

SEQ ID NO: 7694 - DNA, 25 bp, Homo sapiens
tcccaagtaatgatgatcccttccc

SEQ ID NO: 7695 - DNA, 23 bp, Homo sapiens
cgagcagtgcagcctcccgagtg

SEQ ID NO: 7696 - DNA, 23 bp, Homo sapiens
gcccagctgcccatgtctaccct

SEQ ID NO: 7697 - DNA, 23 bp, Homo sapiens
cgagcagtgcagcctcccgagtg

SEQ ID NO: 7698 - DNA, 23 bp, Homo sapiens
tgcccatgtctaccctgctggat

SEQ ID NO: 7699 - DNA, 23 bp, Homo sapiens
gatctcctacccagcctcccagg

SEQ ID NO: 7700 - DNA, 24 bp, Homo sapiens
gagaagctgagagtgagaaaggag

SEQ ID NO: 7701 - DNA, 24 bp, Homo sapiens
ggagaagctgagagtgagaaagga

SEQ ID NO: 7702 - DNA, 24 bp, Homo sapiens
aggagaagctgagagtgagaaagg

SEQ ID NO: 7703 - DNA, 25 bp, Homo sapiens
cctattccagccaacttgtctcaga

SEQ ID NO: 7704 - DNA, 24 bp, Homo sapiens
tgagaaaggaggagaggaactgct

SEQ ID NO: 7705 - DNA, 24 bp, Homo sapiens
agaagcaggagaagcaggagaagc

SEQ ID NO: 7706 - DNA, 23 bp, Homo sapiens
aaagctccacagtccacaggccc

SEQ ID NO: 7707 - DNA, 25 bp, Homo sapiens
ggaccctgatgtggcaccaaatgaa

SEQ ID NO: 7708 - DNA, 23 bp, Homo sapiens
gccgcaccgtggacttgttctta

SEQ ID NO: 7709 - DNA, 25 bp, Homo sapiens
cccagacttcactccatcctttgcc

SEQ ID NO: 7710 - DNA, 25 bp, Homo sapiens
ttgccacagtgttaatgaccgaaga

SEQ ID NO: 7711 - DNA, 25 bp, Homo sapiens
caaagcagagaaagcctggaaaccc

SEQ ID NO: 7712 - DNA, 25 bp, Homo sapiens
gcccagacttcactccatcctttgc

SEQ ID NO: 7713 - DNA, 25 bp, Homo sapiens
gatcccactagactacaaggcataa

SEQ ID NO: 7714 - DNA, 23 bp, Homo sapiens
tggccggacaacccttagcaccc

SEQ ID NO: 7715 - DNA, 25 bp, Homo sapiens
ttgccacagtgttaatgaccgaaga

SEQ ID NO: 7716 - DNA, 25 bp, Homo sapiens
caaagcagagaaagcctggaaaccc

SEQ ID NO: 7717 - DNA, 23 bp, Homo sapiens
cggacggcggctgataaggatcg

SEQ ID NO: 7718 - DNA, 23 bp, Homo sapiens
agctgatgaagcaagtgacgcag

SEQ ID NO: 7719 - DNA, 25 bp, Homo sapiens
cgctccatcctgaataaactgacac

SEQ ID NO: 7720 - DNA, 23 bp, Homo sapiens
cggacggcggctgataaggatcg

SEQ ID NO: 7721 - DNA, 24 bp, Homo sapiens
gctggcaacagcgagttcctgggg

SEQ ID NO: 7722 - DNA, 24 bp, Homo sapiens
tgctggcaacagcgagttcctggg

SEQ ID NO: 7723 - DNA, 24 bp, Homo sapiens
ctgctggcaacagcgagttcctgg

SEQ ID NO: 7724 - DNA, 24 bp, Homo sapiens
agattcttcgttgtcaagccgcca

SEQ ID NO: 7725 - DNA, 24 bp, Homo sapiens
tctcgtttcagtgcttcttcgggc

SEQ ID NO: 7726 - DNA, 24 bp, Homo sapiens
gcacctcagcactatcccaagact

SEQ ID NO: 7727 - DNA, 24 bp, Homo sapiens
aactaatccaccacttatccagga

SEQ ID NO: 7728 - DNA, 24 bp, Homo sapiens
gcaaaaagccaccaccgtcaaagg

SEQ ID NO: 7729 - DNA, 24 bp, Homo sapiens
atcctgaggaggcagctgcggtgg

SEQ ID NO: 7730 - DNA, 24 bp, Homo sapiens
gatcctgaggaggcagctgcggtg

SEQ ID NO: 7731 - DNA, 24 bp, Homo sapiens
ggatcctgaggaggcagctgcggt

SEQ ID NO: 7732 - DNA, 24 bp, Homo sapiens
agtggagagtgcgattgcagaagg

SEQ ID NO: 7733 - DNA, 25 bp, Homo sapiens
acctgcttctgtgataccgctaagt

SEQ ID NO: 7734 - DNA, 25 bp, Homo sapiens
gctgtctgtggtttagatgtcctct

SEQ ID NO: 7735 - DNA, 25 bp, Homo sapiens
cctgagaaggcagagcaaatgtaat

SEQ ID NO: 7736 - DNA, 24 bp, Homo sapiens
gggagaagatacaactgaggaagc

SEQ ID NO: 7737 - DNA, 25 bp, Homo sapiens
gcgtcgaatggatgaaatcagtgac

SEQ ID NO: 7738 - DNA, 25 bp, Homo sapiens
gttctgacactcagtgatgatttgg

SEQ ID NO: 7739 - DNA, 24 bp, Homo sapiens
ttgtttcctagctccaaatcttaa

SEQ ID NO: 7740 - DNA, 24 bp, Homo sapiens
tttgtttcctagctccaaatctta

SEQ ID NO: 7741 - DNA, 24 bp, Homo sapiens
gtttgtttcctagctccaaatctt

SEQ ID NO: 7742 - DNA, 24 bp, Homo sapiens
tgtcaagtttcctggctgggagac

SEQ ID NO: 7743 - DNA, 23 bp, Homo sapiens
ttaccgacttcctctgcttgcca

SEQ ID NO: 7744 - DNA, 25 bp, Homo sapiens
gattcccgtgtgttcttggttcagc

SEQ ID NO: 7745 - DNA, 23 bp, Homo sapiens
cactctggacggctgcttggagg

SEQ ID NO: 7746 - DNA, 23 bp, Homo sapiens
tggtgtcaagtttcctggctggg

SEQ ID NO: 7747 - DNA, 23 bp, Homo sapiens
ttaccgacttcctctgcttgcca

SEQ ID NO: 7748 - DNA, 24 bp, Homo sapiens
gacctcctgggctcaagtgatcct

SEQ ID NO: 7749 - DNA, 24 bp, Homo sapiens
aggctggagtacagtggtgcaatt

SEQ ID NO: 7750 - DNA, 24 bp, Homo sapiens
gcctctcgagtagctgggagtaca

SEQ ID NO: 7751 - DNA, 24 bp, Homo sapiens
gcaggaagacagtgagtatttcca

SEQ ID NO: 7752 - DNA, 24 bp, Homo sapiens
agcaggaagacagtgagtatttcc

SEQ ID NO: 7753 - DNA, 24 bp, Homo sapiens
aagcaggaagacagtgagtatttc

SEQ ID NO: 7754 - DNA, 24 bp, Homo sapiens
tcacagtcactcaccctgttgtcc

SEQ ID NO: 7755 - DNA, 24 bp, Homo sapiens
ctcacagtcactcaccctgttgtc

SEQ ID NO: 7756 - DNA, 24 bp, Homo sapiens
tctcacagtcactcaccctgttgt

SEQ ID NO: 7757 - DNA, 24 bp, Homo sapiens
ttgtctttcagattccactagtat

SEQ ID NO: 7758 - DNA, 24 bp, Homo sapiens
tttgtctttcagattccactagta

SEQ ID NO: 7759 - DNA, 24 bp, Homo sapiens
ttttgtctttcagattccactagt

SEQ ID NO: 7760 - DNA, 24 bp, Homo sapiens
gtggactcacactttcgacaggga

SEQ ID NO: 7761 - DNA, 24 bp, Homo sapiens
agtggtggaattgactggaaggca

SEQ ID NO: 7762 - DNA, 24 bp, Homo sapiens
gcaccctttcaccgtggaggaatt

SEQ ID NO: 7763 - DNA, 24 bp, Homo sapiens
gccacataaagcccttgaagataa

SEQ ID NO: 7764 - DNA, 24 bp, Homo sapiens
agccacataaagcccttgaagata

SEQ ID NO: 7765 - DNA, 24 bp, Homo sapiens
cagccacataaagcccttgaagat

SEQ ID NO: 7766 - DNA, 23 bp, Homo sapiens
gtgtagactggcacagcaccttg

SEQ ID NO: 7767 - DNA, 25 bp, Homo sapiens
agggagaagttacgggaagggagag

SEQ ID NO: 7768 - DNA, 25 bp, Homo sapiens
gagcgacagttcaaggaggagaagc

SEQ ID NO: 7769 - DNA, 25 bp, Homo sapiens
gctgatggaagtggaagtgcctgaa

SEQ ID NO: 7770 - DNA, 25 bp, Homo sapiens
acctgactcattccagcactacaga

SEQ ID NO: 7771 - DNA, 24 bp, Homo sapiens
tcatttgaggaacagcacatcagc

SEQ ID NO: 7772 - DNA, 24 bp, Homo sapiens
tgatgcaccagggcgtccccctgg

SEQ ID NO: 7773 - DNA, 24 bp, Homo sapiens
atgatgcaccagggcgtccccctg

SEQ ID NO: 7774 - DNA, 24 bp, Homo sapiens
tatgatgcaccagggcgtccccct

SEQ ID NO: 7775 - DNA, 25 bp, Homo sapiens
gctatcctcatcctcttcccgacct

SEQ ID NO: 7776 - DNA, 23 bp, Homo sapiens
agcctgccaatgtgcctgtcctc

SEQ ID NO: 7777 - DNA, 23 bp, Homo sapiens
cctacctgacctcaccaacctgc

SEQ ID NO: 7778 - DNA, 23 bp, Homo sapiens
taagtccagccagactgcaaggt

SEQ ID NO: 7779 - DNA, 23 bp, Homo sapiens
ccaagccccttgctctccagtat

SEQ ID NO: 7780 - DNA, 23 bp, Homo sapiens
ctggagtactctcagtcctgttg

SEQ ID NO: 7781 - DNA, 25 bp, Homo sapiens
agaccttcagttcctccaagtcctg

SEQ ID NO: 7782 - DNA, 25 bp, Homo sapiens
ggctcatgtcttcctctgtagatac

SEQ ID NO: 7783 - DNA, 25 bp, Homo sapiens
gagatggaagaaggtgagttcaaga

SEQ ID NO: 7784 - DNA, 25 bp, Homo sapiens
gtgcctgtgtcagtccttggattgt

SEQ ID NO: 7785 - DNA, 24 bp, Homo sapiens
gccttcttatcagtgtccaagcat

SEQ ID NO: 7786 - DNA, 25 bp, Homo sapiens
ttccaatgagtcctggtctatgtca

SEQ ID NO: 7787 - DNA, 23 bp, Homo sapiens
cctgtggtcactccatccatcat

SEQ ID NO: 7788 - DNA, 25 bp, Homo sapiens
ttccaatgagtcctggtctatgtca

SEQ ID NO: 7789 - DNA, 25 bp, Homo sapiens
gcatacaattcttacatattcctgg

SEQ ID NO: 7790 - DNA, 25 bp, Homo sapiens
gagatggaagaaggtgagttcaaga

SEQ ID NO: 7791 - DNA, 25 bp, Homo sapiens
gcaaggctcatgtcttcctctgtag

SEQ ID NO: 7792 - DNA, 25 bp, Homo sapiens
agcttggaataacaggttgcaggac

SEQ ID NO: 7793 - DNA, 24 bp, Homo sapiens
tccatcaccaggtgcatgatgacg

SEQ ID NO: 7794 - DNA, 24 bp, Homo sapiens
ttccatcaccaggtgcatgatgac

SEQ ID NO: 7795 - DNA, 24 bp, Homo sapiens
tttccatcaccaggtgcatgatga

SEQ ID NO: 7796 - DNA, 24 bp, Homo sapiens
gcaagggctacaatgacgactact

SEQ ID NO: 7797 - DNA, 24 bp, Homo sapiens
gctacttcaccaccaggacttatg

SEQ ID NO: 7798 - DNA, 24 bp, Homo sapiens
gcctaccagagcatcacgcactac

SEQ ID NO: 7799 - DNA, 24 bp, Homo sapiens
tcctacctcagcctcctgagtagc

SEQ ID NO: 7800 - DNA, 24 bp, Homo sapiens
ctcctacctcagcctcctgagtag

SEQ ID NO: 7801 - DNA, 24 bp, Homo sapiens
tctcctacctcagcctcctgagta

SEQ ID NO: 7802 - DNA, 23 bp, Homo sapiens
tgtcccacgaggtcacccagcac

SEQ ID NO: 7803 - DNA, 25 bp, Homo sapiens
aaggacctatccgacttccaccagt

SEQ ID NO: 7804 - DNA, 24 bp, Homo sapiens
ccatcaccagcatcgagtaccagt

SEQ ID NO: 7805 - DNA, 24 bp, Homo sapiens
taactcagcaggtagtgtggtact

SEQ ID NO: 7806 - DNA, 24 bp, Homo sapiens
ttaactcagcaggtagtgtggtac

SEQ ID NO: 7807 - DNA, 24 bp, Homo sapiens
gttaactcagcaggtagtgtggta

SEQ ID NO: 7808 - DNA, 25 bp, Homo sapiens
cgccatcaccatcggaatcatcaga

SEQ ID NO: 7809 - DNA, 25 bp, Homo sapiens
cgcaagctccgccctcagttatatt

SEQ ID NO: 7810 - DNA, 25 bp, Homo sapiens
cctacaggtgaaattcctaagcagg

SEQ ID NO: 7811 - DNA, 25 bp, Homo sapiens
ggaagagtccacctcaattaagaca

SEQ ID NO: 7812 - DNA, 25 bp, Homo sapiens
aaggcgattggattggactttaccg

SEQ ID NO: 7813 - DNA, 25 bp, Homo sapiens
cgagagcacttacctgtgaaacctg

SEQ ID NO: 7814 - DNA, 25 bp, Homo sapiens
gcactctccttatcagcaagatccg

SEQ ID NO: 7815 - DNA, 23 bp, Homo sapiens
gccaccctctccgtccatcagtt

SEQ ID NO: 7816 - DNA, 25 bp, Homo sapiens
aataccttcagtgtggtgccttcac

SEQ ID NO: 7817 - DNA, 24 bp, Homo sapiens
agggcttccagctgacccactcac

SEQ ID NO: 7818 - DNA, 24 bp, Homo sapiens
cagggcttccagctgacccactca

SEQ ID NO: 7819 - DNA, 24 bp, Homo sapiens
gcagggcttccagctgacccactc

SEQ ID NO: 7820 - DNA, 25 bp, Homo sapiens
gatgtggtacggaaggaggcagaga

SEQ ID NO: 7821 - DNA, 23 bp, Homo sapiens
gcttccagctgacccactcactg

SEQ ID NO: 7822 - DNA, 25 bp, Homo sapiens
tggttgattctgtcctggatgtggt

SEQ ID NO: 7823 - DNA, 25 bp, Homo sapiens
gcactctccttatcagcaagatccg

SEQ ID NO: 7824 - DNA, 23 bp, Homo sapiens
ccctacaatgccaccctctccgt

SEQ ID NO: 7825 - DNA, 23 bp, Homo sapiens
gcagagagctgtgactgcctgca

SEQ ID NO: 7826 - DNA, 24 bp, Homo sapiens
gcactctccttatcagcaagatcc

SEQ ID NO: 7827 - DNA, 24 bp, Homo sapiens
ggcactctccttatcagcaagatc

SEQ ID NO: 7828 - DNA, 24 bp, Homo sapiens
gggcactctccttatcagcaagat

SEQ ID NO: 7829 - DNA, 24 bp, Homo sapiens
agcaagatccgcctgcctccgttt

SEQ ID NO: 7830 - DNA, 24 bp, Homo sapiens
cagcaagatccgcctgcctccgtt

SEQ ID NO: 7831 - DNA, 24 bp, Homo sapiens
tcagcaagatccgcctgcctccgt

SEQ ID NO: 7832 - DNA, 23 bp, Homo sapiens
gacctccgcaagttggcagtcaa

SEQ ID NO: 7833 - DNA, 23 bp, Homo sapiens
cagccgtggaagccagcagtatc

SEQ ID NO: 7834 - DNA, 25 bp, Homo sapiens
aagaacatgatggctgcctgtgacc

SEQ ID NO: 7835 - DNA, 23 bp, Homo sapiens
acaggctctggaatgggcactct

SEQ ID NO: 7836 - DNA, 24 bp, Homo sapiens
tggttgattctgtcctggatgtgg

SEQ ID NO: 7837 - DNA, 23 bp, Homo sapiens
gcttccagctgacccactcactg

SEQ ID NO: 7838 - DNA, 24 bp, Homo sapiens
cagtgtctcaagcacaaatgtcta

SEQ ID NO: 7839 - DNA, 24 bp, Homo sapiens
ccagtgtctcaagcacaaatgtct

SEQ ID NO: 7840 - DNA, 24 bp, Homo sapiens
tccagtgtctcaagcacaaatgtc

SEQ ID NO: 7841 - DNA, 24 bp, Homo sapiens
gtggcagaaagttggagttctctc

SEQ ID NO: 7842 - DNA, 24 bp, Homo sapiens
tgtggcagaaagttggagttctct

SEQ ID NO: 7843 - DNA, 24 bp, Homo sapiens
ttgtggcagaaagttggagttctc

SEQ ID NO: 7844 - DNA, 24 bp, Homo sapiens
tggcctgctggattcgtctgtgat

SEQ ID NO: 7845 - DNA, 24 bp, Homo sapiens
ctggcctgctggattcgtctgtga

SEQ ID NO: 7846 - DNA, 24 bp, Homo sapiens
tctggcctgctggattcgtctgtg

SEQ ID NO: 7847 - DNA, 24 bp, Homo sapiens
atgaaagcaaggtttgtggacagt

SEQ ID NO: 7848 - DNA, 24 bp, Homo sapiens
catgaaagcaaggtttgtggacag

SEQ ID NO: 7849 - DNA, 24 bp, Homo sapiens
gcatgaaagcaaggtttgtggaca

SEQ ID NO: 7850 - DNA, 24 bp, Homo sapiens
cccaaccagaggagagtatacata

SEQ ID NO: 7851 - DNA, 24 bp, Homo sapiens
acccaaccagaggagagtatacat

SEQ ID NO: 7852 - DNA, 24 bp, Homo sapiens
cacccaaccagaggagagtataca

SEQ ID NO: 7853 - DNA, 24 bp, Homo sapiens
caaacccctcctcttcagcaccat

SEQ ID NO: 7854 - DNA, 24 bp, Homo sapiens
tctcaacccgcctatgggctatgg

SEQ ID NO: 7855 - DNA, 24 bp, Homo sapiens
gccagttccttcctcagactcagt

SEQ ID NO: 7856 - DNA, 24 bp, Homo sapiens
ttgatggtgttgacctgtgcttct

SEQ ID NO: 7857 - DNA, 24 bp, Homo sapiens
gtggacagtggagagatggcagaa

SEQ ID NO: 7858 - DNA, 24 bp, Homo sapiens
tcgtgtgaatgactttctgaggcg

SEQ ID NO: 7859 - DNA, 24 bp, Homo sapiens
gacacaggcaggcttgacttctcc

SEQ ID NO: 7860 - DNA, 24 bp, Homo sapiens
gcttcagacaagtcttggcatggt

SEQ ID NO: 7861 - DNA, 24 bp, Homo sapiens
ggtcctacgcagtcaacaggtatg

SEQ ID NO: 7862 - DNA, 24 bp, Homo sapiens
gcaacttactgactgagcctcttc

SEQ ID NO: 7863 - DNA, 24 bp, Homo sapiens
atgaacacagggatgaatgcgggc

SEQ ID NO: 7864 - DNA, 24 bp, Homo sapiens
ccaaatcagggtcctacgcagtca

SEQ ID NO: 7865 - DNA, 24 bp, Homo sapiens
ctcgacaaatcatttcacactgga

SEQ ID NO: 7866 - DNA, 24 bp, Homo sapiens
gtctccccctcaaaaatgctggtg

SEQ ID NO: 7867 - DNA, 24 bp, Homo sapiens
attgtacaagacatgattgtcctg

SEQ ID NO: 7868 - DNA, 24 bp, Homo sapiens
ccactgtcgcacaatgaagaatgt

SEQ ID NO: 7869 - DNA, 24 bp, Homo sapiens
cctggtggaggaatgcccaacatg

SEQ ID NO: 7870 - DNA, 24 bp, Homo sapiens
atcctggacagcagattggagcca

SEQ ID NO: 7871 - DNA, 24 bp, Homo sapiens
gtaaatcagatgccgacacaaccc

SEQ ID NO: 7872 - DNA, 24 bp, Homo sapiens
ggaggtgtaggagttcaaacgccg

SEQ ID NO: 7873 - DNA, 24 bp, Homo sapiens
gtggcacgaagatattactcagga

SEQ ID NO: 7874 - DNA, 24 bp, Homo sapiens
acatgattgtcctgtgtgtctccc

SEQ ID NO: 7875 - DNA, 24 bp, Homo sapiens
ccactgtcgcacaatgaagaatgt

SEQ ID NO: 7876 - DNA, 24 bp, Homo sapiens
cctggtggaggaatgcccaacatg

SEQ ID NO: 7877 - DNA, 24 bp, Homo sapiens
gtaaatcagatgccgacacaaccc

SEQ ID NO: 7878 - DNA, 24 bp, Homo sapiens
ggagcacccgttggacttggaaat

SEQ ID NO: 7879 - DNA, 24 bp, Homo sapiens
acatgattgtcctgtgtgtctccc

SEQ ID NO: 7880 - DNA, 24 bp, Homo sapiens
ccaacagcagctcaaccatccact

SEQ ID NO: 7881 - DNA, 24 bp, Homo sapiens
ggaggtgtaggagttcaaacgccg

SEQ ID NO: 7882 - DNA, 24 bp, Homo sapiens
gtaaatcagatgccgacacaaccc

SEQ ID NO: 7883 - DNA, 24 bp, Homo sapiens
acgaaggaccagactacagaagca

SEQ ID NO: 7884 - DNA, 24 bp, Homo sapiens
gacagccgcaaccaggaatgactt

SEQ ID NO: 7885 - DNA, 24 bp, Homo sapiens
gccagttccttcctcagactcagt

SEQ ID NO: 7886 - DNA, 24 bp, Homo sapiens
acgaaggaccagactacagaagca

SEQ ID NO: 7887 - DNA, 24 bp, Homo sapiens
atccagggcctaacatgggacagc

SEQ ID NO: 7888 - DNA, 24 bp, Homo sapiens
aatgctgcaggcatggttccagtt

SEQ ID NO: 7889 - DNA, 24 bp, Homo sapiens
gccagttccttcctcagactcagt

SEQ ID NO: 7890 - DNA, 24 bp, Homo sapiens
gcggtcaagctccagtgtctcaag

SEQ ID NO: 7891 - DNA, 24 bp, Homo sapiens
cggtgaactctcctataatgcctc

SEQ ID NO: 7892 - DNA, 24 bp, Homo sapiens
caaacccctcctcttcagcaccat

SEQ ID NO: 7893 - DNA, 24 bp, Homo sapiens
catggcccagccccctattgtacc

SEQ ID NO: 7894 - DNA, 24 bp, Homo sapiens
gccagttccttcctcagactcagt

SEQ ID NO: 7895 - DNA, 24 bp, Homo sapiens
cggtgaactctcctataatgcctc

SEQ ID NO: 7896 - DNA, 24 bp, Homo sapiens
tcagcagccaccagcaacaacaat

SEQ ID NO: 7897 - DNA, 24 bp, Homo sapiens
cgtatgcaacagccttccaaccag

SEQ ID NO: 7898 - DNA, 24 bp, Homo sapiens
tcctcagactcagttcccatcaca

SEQ ID NO: 7899 - DNA, 24 bp, Homo sapiens
aatatccctttggctccgtccagc

SEQ ID NO: 7900 - DNA, 24 bp, Homo sapiens
gccagttccttcctcagactcagt

SEQ ID NO: 7901 - DNA, 24 bp, Homo sapiens
tgtgccaaaccagatgatgcctcg

SEQ ID NO: 7902 - DNA, 24 bp, Homo sapiens
gccctctacctgacccaagtatga

SEQ ID NO: 7903 - DNA, 24 bp, Homo sapiens
ccagaaccagcagatactcagccg

SEQ ID NO: 7904 - DNA, 24 bp, Homo sapiens
aagaggaggaagaccagccaagta

SEQ ID NO: 7905 - DNA, 24 bp, Homo sapiens
accagaagaactacgacaggcact

SEQ ID NO: 7906 - DNA, 24 bp, Homo sapiens
tcaaccagaaccagcagatactca

SEQ ID NO: 7907 - DNA, 24 bp, Homo sapiens
ttcccaggaagtgaagatggaggc

SEQ ID NO: 7908 - DNA, 24 bp, Homo sapiens
ggacaggtatcaaatcctccatct

SEQ ID NO: 7909 - DNA, 24 bp, Homo sapiens
aagaggaggaagaccagccaagta

SEQ ID NO: 7910 - DNA, 24 bp, Homo sapiens
accgaaacagaagagagaagcact

SEQ ID NO: 7911 - DNA, 24 bp, Homo sapiens
ccagaaccagcagatactcagccg

SEQ ID NO: 7912 - DNA, 24 bp, Homo sapiens
gacccttcccagcctcaaactaca

SEQ ID NO: 7913 - DNA, 24 bp, Homo sapiens
gctggattcgtctgtgatggctgt

SEQ ID NO: 7914 - DNA, 24 bp, Homo sapiens
aaggttgccatctaccagacttgg

SEQ ID NO: 7915 - DNA, 24 bp, Homo sapiens
gcacaatacctcgtgatgccactt

SEQ ID NO: 7916 - DNA, 24 bp, Homo sapiens
acactgtgttgctacggcaaacag

SEQ ID NO: 7917 - DNA, 24 bp, Homo sapiens
gctggattcgtctgtgatggctgt

SEQ ID NO: 7918 - DNA, 24 bp, Homo sapiens
tcgtgtgaatgactttctgaggcg

SEQ ID NO: 7919 - DNA, 24 bp, Homo sapiens
tgagtcaggagaggtcactgttag

SEQ ID NO: 7920 - DNA, 24 bp, Homo sapiens
tcgtgtgaatgactttctgaggcg

SEQ ID NO: 7921 - DNA, 24 bp, Homo sapiens
tgagtcaggagaggtcactgttag

SEQ ID NO: 7922 - DNA, 24 bp, Homo sapiens
gtggacagtggagagatggcagaa

SEQ ID NO: 7923 - DNA, 24 bp, Homo sapiens
cgtgtgaatgactttctgaggcga

SEQ ID NO: 7924 - DNA, 24 bp, Homo sapiens
tgagtcaggagaggtcactgttag

SEQ ID NO: 7925 - DNA, 24 bp, Homo sapiens
gtggacagtggagagatggcagaa

SEQ ID NO: 7926 - DNA, 24 bp, Homo sapiens
gctggattcgtctgtgatggctgt

SEQ ID NO: 7927 - DNA, 24 bp, Homo sapiens
gtacagagtgcggaagaaagatgc

SEQ ID NO: 7928 - DNA, 24 bp, Homo sapiens
gacccttcccagcctcaaactaca

SEQ ID NO: 7929 - DNA, 24 bp, Homo sapiens
tccataccgaaccaaagccctctt

SEQ ID NO: 7930 - DNA, 24 bp, Homo sapiens
tgatggtgttgacctgtgcttctt

SEQ ID NO: 7931 - DNA, 24 bp, Homo sapiens
ctctgactgccctccacccaacca

SEQ ID NO: 7932 - DNA, 24 bp, Homo sapiens
tccataccgaaccaaagccctctt

SEQ ID NO: 7933 - DNA, 24 bp, Homo sapiens
tgatggtgttgacctgtgcttctt

SEQ ID NO: 7934 - DNA, 24 bp, Homo sapiens
gcatgttcaagagtatggctctga

SEQ ID NO: 7935 - DNA, 24 bp, Homo sapiens
tgagtcaggagaggtcactgttag

SEQ ID NO: 7936 - DNA, 24 bp, Homo sapiens
tcgtgtgaatgactttctgaggcg

SEQ ID NO: 7937 - DNA, 24 bp, Homo sapiens
aaggttgccatctaccagacttgg

SEQ ID NO: 7938 - DNA, 24 bp, Homo sapiens
ctctgactgccctccacccaacca

SEQ ID NO: 7939 - DNA, 24 bp, Homo sapiens
ttgatggtgttgacctgtgcttct

SEQ ID NO: 7940 - DNA, 24 bp, Homo sapiens
gtggacagtggagagatggcagaa

SEQ ID NO: 7941 - DNA, 24 bp, Homo sapiens
gtcagctcagcccggcctccgact

SEQ ID NO: 7942 - DNA, 24 bp, Homo sapiens
ggtcagctcagcccggcctccgac

SEQ ID NO: 7943 - DNA, 24 bp, Homo sapiens
tggtcagctcagcccggcctccga

SEQ ID NO: 7944 - DNA, 23 bp, Homo sapiens
gaagacgagccacctgagcaagc

SEQ ID NO: 7945 - DNA, 25 bp, Homo sapiens
ccacttctgcacctgccattactca

SEQ ID NO: 7946 - DNA, 23 bp, Homo sapiens
ccacacttcgagcgtacagcaag

SEQ ID NO: 7947 - DNA, 24 bp, Homo sapiens
aacatcatgccagcatcagtgagc

SEQ ID NO: 7948 - DNA, 25 bp, Homo sapiens
tcaccatctcagataatgccaatgc

SEQ ID NO: 7949 - DNA, 25 bp, Homo sapiens
ccacactgagaccaagaccatcact

SEQ ID NO: 7950 - DNA, 23 bp, Homo sapiens
tctgcccttctcccatccaagag

SEQ ID NO: 7951 - DNA, 25 bp, Homo sapiens
accaagaacaaggagcggacatcag

SEQ ID NO: 7952 - DNA, 25 bp, Homo sapiens
tcacagcaccaacagaaggaagagg

SEQ ID NO: 7953 - DNA, 24 bp, Homo sapiens
tcaggtgtccgaggaagaaggcaa

SEQ ID NO: 7954 - DNA, 23 bp, Homo sapiens
gcaaaggagcagcacccagacat

SEQ ID NO: 7955 - DNA, 25 bp, Homo sapiens
aggagaccgagattgctgatgagtg

SEQ ID NO: 7956 - DNA, 24 bp, Homo sapiens
ccaactctgcccttctcccatcca

SEQ ID NO: 7957 - DNA, 24 bp, Homo sapiens
cttccatacctccttgcaccaggg

SEQ ID NO: 7958 - DNA, 24 bp, Homo sapiens
ccttccatacctccttgcaccagg

SEQ ID NO: 7959 - DNA, 24 bp, Homo sapiens
cccttccatacctccttgcaccag

SEQ ID NO: 7960 - DNA, 24 bp, Homo sapiens
ccaccaccctgagacctcccgccc

SEQ ID NO: 7961 - DNA, 24 bp, Homo sapiens
tccaccaccctgagacctcccgcc

SEQ ID NO: 7962 - DNA, 24 bp, Homo sapiens
ttccaccaccctgagacctcccgc

SEQ ID NO: 7963 - DNA, 24 bp, Homo sapiens
aactcagtaaggttacttccaact

SEQ ID NO: 7964 - DNA, 24 bp, Homo sapiens
gaactcagtaaggttacttccaac

SEQ ID NO: 7965 - DNA, 24 bp, Homo sapiens
ggaactcagtaaggttacttccaa

SEQ ID NO: 7966 - DNA, 24 bp, Homo sapiens
tgctgggctacaaggacctggctg

SEQ ID NO: 7967 - DNA, 24 bp, Homo sapiens
tacgagcctcacttcacttattcc

SEQ ID NO: 7968 - DNA, 24 bp, Homo sapiens
gctcgctgtcacccaaatccacat

SEQ ID NO: 7969 - DNA, 24 bp, Homo sapiens
ccctcccgagattccagtgtgcct

SEQ ID NO: 7970 - DNA, 24 bp, Homo sapiens
tacgagcctcacttcacttattcc

SEQ ID NO: 7971 - DNA, 24 bp, Homo sapiens
gctcgctgtcacccaaatccacat

SEQ ID NO: 7972 - DNA, 24 bp, Homo sapiens
gacagaatggaggaagcggaaggc

SEQ ID NO: 7973 - DNA, 24 bp, Homo sapiens
agcagaggaagaggaggaggagga

SEQ ID NO: 7974 - DNA, 24 bp, Homo sapiens
cgactctggagaggagatgaaggc

SEQ ID NO: 7975 - DNA, 24 bp, Homo sapiens
aggaggaggaggaagatgacgact

SEQ ID NO: 7976 - DNA, 24 bp, Homo sapiens
ggaaggcgtctcggaggggagcag

SEQ ID NO: 7977 - DNA, 24 bp, Homo sapiens
aggagatgaaggctctcagggagc

SEQ ID NO: 7978 - DNA, 24 bp, Homo sapiens
catcagggagtgagactggaagcc

SEQ ID NO: 7979 - DNA, 24 bp, Homo sapiens
ggaactccctgccctgtgtgctgg

SEQ ID NO: 7980 - DNA, 24 bp, Homo sapiens
ctgtctgccgaggacttctcaagg

SEQ ID NO: 7981 - DNA, 24 bp, Homo sapiens
ggaactccctgccctgtgtgctgg

SEQ ID NO: 7982 - DNA, 24 bp, Homo sapiens
ccctatgaaatgctagtggtgacc

SEQ ID NO: 7983 - DNA, 24 bp, Homo sapiens
ctgtctgccgaggacttctcaagg

SEQ ID NO: 7984 - DNA, 24 bp, Homo sapiens
gtccacagagttcagcccatcagg

SEQ ID NO: 7985 - DNA, 24 bp, Homo sapiens
cgactctggagaggagatgaaggc

SEQ ID NO: 7986 - DNA, 24 bp, Homo sapiens
gacagaatggaggaagcggaaggc

SEQ ID NO: 7987 - DNA, 24 bp, Homo sapiens
gagaatggcggggcctcacaccct

SEQ ID NO: 7988 - DNA, 24 bp, Homo sapiens
ggagaatggcggggcctcacaccc

SEQ ID NO: 7989 - DNA, 24 bp, Homo sapiens
gggagaatggcggggcctcacacc

SEQ ID NO: 7990 - DNA, 24 bp, Homo sapiens
gccagcgttgccacatccatctgt

SEQ ID NO: 7991 - DNA, 24 bp, Homo sapiens
ccacaggttactcagcctagtgcc

SEQ ID NO: 7992 - DNA, 24 bp, Homo sapiens
gaaccctccagtcacaaccaacat

SEQ ID NO: 7993 - DNA, 24 bp, Homo sapiens
tgacagagaatgagacgcctacaa

SEQ ID NO: 7994 - DNA, 24 bp, Homo sapiens
gtgacctggagttcactcactgct

SEQ ID NO: 7995 - DNA, 24 bp, Homo sapiens
agtgacctggagttcactcactgc

SEQ ID NO: 7996 - DNA, 24 bp, Homo sapiens
tagtgacctggagttcactcactg

SEQ ID NO: 7997 - DNA, 24 bp, Homo sapiens
acttgtggttgacttcttgactga

SEQ ID NO: 7998 - DNA, 24 bp, Homo sapiens
acctccctcgccgtgtaacaaatg

SEQ ID NO: 7999 - DNA, 24 bp, Homo sapiens
cctgcctggtgctggtgctcaaca

SEQ ID NO: 8000 - DNA, 24 bp, Homo sapiens
gtcgagttctcccaccgctctggc

SEQ ID NO: 8001 - DNA, 24 bp, Homo sapiens
gccaagaagaggaccaacatcatt

SEQ ID NO: 8002 - DNA, 24 bp, Homo sapiens
cgacacccacacaaataccgcatg

SEQ ID NO: 8003 - DNA, 24 bp, Homo sapiens
ccgtggtggtcgtggaggccgagg

SEQ ID NO: 8004 - DNA, 24 bp, Homo sapiens
accgtggtggtcgtggaggccgag

SEQ ID NO: 8005 - DNA, 24 bp, Homo sapiens
gaccgtggtggtcgtggaggccga

SEQ ID NO: 8006 - DNA, 24 bp, Homo sapiens
ccgtggtggtcgtggaggcttcca

SEQ ID NO: 8007 - DNA, 24 bp, Homo sapiens
accgtggtggtcgtggaggcttcc

SEQ ID NO: 8008 - DNA, 24 bp, Homo sapiens
gaccgtggtggtcgtggaggcttc

SEQ ID NO: 8009 - DNA, 24 bp, Homo sapiens
gccaagaagaggaccaacatcatt

SEQ ID NO: 8010 - DNA, 24 bp, Homo sapiens
caccgctctggccgtgacctcatt

SEQ ID NO: 8011 - DNA, 24 bp, Homo sapiens
atcgaggatgctcgacacccacac

SEQ ID NO: 8012 - DNA, 24 bp, Homo sapiens
gccaagaagaggaccaacatcatt

SEQ ID NO: 8013 - DNA, 24 bp, Homo sapiens
caccacggtctcccatgtctctga

SEQ ID NO: 8014 - DNA, 24 bp, Homo sapiens
gaagaatgtgatggtggagccgca

SEQ ID NO: 8015 - DNA, 24 bp, Homo sapiens
gaccatccagggtgagcccccagc

SEQ ID NO: 8016 - DNA, 24 bp, Homo sapiens
ggaccatccagggtgagcccccag

SEQ ID NO: 8017 - DNA, 24 bp, Homo sapiens
aggaccatccagggtgagccccca

SEQ ID NO: 8018 - DNA, 24 bp, Homo sapiens
ctgctgctcacgctaccgctcctc

SEQ ID NO: 8019 - DNA, 24 bp, Homo sapiens
acgaggccctgctggagtatgaag

SEQ ID NO: 8020 - DNA, 24 bp, Homo sapiens
gagggggtgctgagcggcggcggg

SEQ ID NO: 8021 - DNA, 24 bp, Homo sapiens
aataactccaagcagactccagcc

SEQ ID NO: 8022 - DNA, 24 bp, Homo sapiens
gagtgggacttggagagcaaaggc

SEQ ID NO: 8023 - DNA, 24 bp, Homo sapiens
gcgtgggaggcagaaacctatctc

SEQ ID NO: 8024 - DNA, 24 bp, Homo sapiens
cagtgctgccccctgcagagcaat

SEQ ID NO: 8025 - DNA, 24 bp, Homo sapiens
acagtgctgccccctgcagagcaa

SEQ ID NO: 8026 - DNA, 24 bp, Homo sapiens
cacagtgctgccccctgcagagca

SEQ ID NO: 8027 - DNA, 24 bp, Homo sapiens
gcctcccactggttatactactcc

SEQ ID NO: 8028 - DNA, 24 bp, Homo sapiens
agcctcccactggttatactactc

SEQ ID NO: 8029 - DNA, 24 bp, Homo sapiens
cagcctcccactggttatactact

SEQ ID NO: 8030 - DNA, 24 bp, Homo sapiens
gcacctacaagaccgcaggatgga

SEQ ID NO: 8031 - DNA, 24 bp, Homo sapiens
tgcacctacaagaccgcaggatgg

SEQ ID NO: 8032 - DNA, 24 bp, Homo sapiens
ctgcacctacaagaccgcaggatg

SEQ ID NO: 8033 - DNA, 24 bp, Homo sapiens
ggtggaatgggcagcgctggagag

SEQ ID NO: 8034 - DNA, 24 bp, Homo sapiens
cggtggaatgggcagcgctggaga

SEQ ID NO: 8035 - DNA, 24 bp, Homo sapiens
gcggtggaatgggcagcgctggag

SEQ ID NO: 8036 - DNA, 23 bp, Homo sapiens
gctatacccaggctcagaccact

SEQ ID NO: 8037 - DNA, 24 bp, Homo sapiens
atggaacctatggacagcccactg

SEQ ID NO: 8038 - DNA, 23 bp, Homo sapiens
gcagaccgcctatgcaacttctt

SEQ ID NO: 8039 - DNA, 25 bp, Homo sapiens
tgcttatgataccaccactgctaca

SEQ ID NO: 8040 - DNA, 25 bp, Homo sapiens
ctcagcctgcttatccagcctatgg

SEQ ID NO: 8041 - DNA, 23 bp, Homo sapiens
gcacctacaagaccgcaggatgg

SEQ ID NO: 8042 - DNA, 24 bp, Homo sapiens
caaccgagcagctatggacagcag

SEQ ID NO: 8043 - DNA, 24 bp, Homo sapiens
gcaaccgagcagctatggacagca

SEQ ID NO: 8044 - DNA, 24 bp, Homo sapiens
ggcaaccgagcagctatggacagc

SEQ ID NO: 8045 - DNA, 23 bp, Homo sapiens
accgagcagctatggacagcaga

SEQ ID NO: 8046 - DNA, 25 bp, Homo sapiens
agcagttactctcagcagaacacct

SEQ ID NO: 8047 - DNA, 25 bp, Homo sapiens
ggcagacttctttaagcagtgtggg

SEQ ID NO: 8048 - DNA, 25 bp, Homo sapiens
agatgaacaagagaactgggcaacc

SEQ ID NO: 8049 - DNA, 25 bp, Homo sapiens
gcgatgccacagtgtcctatgaaga

SEQ ID NO: 8050 - DNA, 23 bp, Homo sapiens
gagacagaggtggcttccgtggt

SEQ ID NO: 8051 - DNA, 24 bp, Homo sapiens
aggtggctttggtggaggaagacg

SEQ ID NO: 8052 - DNA, 24 bp, Homo sapiens
gaggtggctttggtggaggaagac

SEQ ID NO: 8053 - DNA, 24 bp, Homo sapiens
cgaggtggctttggtggaggaaga

SEQ ID NO: 8054 - DNA, 24 bp, Homo sapiens
tggtggtcccggtggaggaagacg

SEQ ID NO: 8055 - DNA, 24 bp, Homo sapiens
gtggtggtcccggtggaggaagac

SEQ ID NO: 8056 - DNA, 24 bp, Homo sapiens
cgtggtggtcccggtggaggaaga

SEQ ID NO: 8057 - DNA, 24 bp, Homo sapiens
caatgttccctgagaatggtgtcc

SEQ ID NO: 8058 - DNA, 24 bp, Homo sapiens
ccaaatgacatgatcttcagtgca

SEQ ID NO: 8059 - DNA, 24 bp, Homo sapiens
ggcaacaaaaagagttccaagaaa

SEQ ID NO: 8060 - DNA, 24 bp, Homo sapiens
aatgttccctgagaatggtgtccc

SEQ ID NO: 8061 - DNA, 24 bp, Homo sapiens
cccaaatgacatgatcttcagtgc

SEQ ID NO: 8062 - DNA, 24 bp, Homo sapiens
aggggccgcaggtgagccaggcag

SEQ ID NO: 8063 - DNA, 24 bp, Homo sapiens
caggggccgcaggtgagccaggca

SEQ ID NO: 8064 - DNA, 24 bp, Homo sapiens
gcaggggccgcaggtgagccaggc

SEQ ID NO: 8065 - DNA, 24 bp, Homo sapiens
tcagccgccgccacccaggccgtg

SEQ ID NO: 8066 - DNA, 23 bp, Homo sapiens
ctcactgcaagctctgcctcctg

SEQ ID NO: 8067 - DNA, 23 bp, Homo sapiens
caattgtcctgcctcagcctcct

SEQ ID NO: 8068 - DNA, 24 bp, Homo sapiens
tcctgcctcagcccccaccatcct

SEQ ID NO: 8069 - DNA, 24 bp, Homo sapiens
ttcctgcctcagcccccaccatcc

SEQ ID NO: 8070 - DNA, 24 bp, Homo sapiens
tttcctgcctcagcccccaccatc

SEQ ID NO: 8071 - DNA, 24 bp, Homo sapiens
gcgagggcgaggtgtgtgtgaaag

SEQ ID NO: 8072 - DNA, 24 bp, Homo sapiens
ggcgagggcgaggtgtgtgtgaaa

SEQ ID NO: 8073 - DNA, 24 bp, Homo sapiens
gggcgagggcgaggtgtgtgtgaa

SEQ ID NO: 8074 - DNA, 24 bp, Homo sapiens
aggcgatggaggacctgggaagag

SEQ ID NO: 8075 - DNA, 24 bp, Homo sapiens
aaggcgatggaggacctgggaaga

SEQ ID NO: 8076 - DNA, 24 bp, Homo sapiens
gaaggcgatggaggacctgggaag

SEQ ID NO: 8077 - DNA, 24 bp, Homo sapiens
ggaagcccaagcctccagcacctg

SEQ ID NO: 8078 - DNA, 24 bp, Homo sapiens
cggaagcccaagcctccagcacct

SEQ ID NO: 8079 - DNA, 24 bp, Homo sapiens
acggaagcccaagcctccagcacc

SEQ ID NO: 8080 - DNA, 24 bp, Homo sapiens
gagcaatggtcactcaccgaaaca

SEQ ID NO: 8081 - DNA, 24 bp, Homo sapiens
tcacaagtggaactacaggcaacc

SEQ ID NO: 8082 - DNA, 24 bp, Homo sapiens
ccaagcctccagcacctgaagatc

SEQ ID NO: 8083 - DNA, 24 bp, Homo sapiens
ccaagcctccagcacctgaagatc

SEQ ID NO: 8084 - DNA, 24 bp, Homo sapiens
tcacaagtggaactacaggcaacc

SEQ ID NO: 8085 - DNA, 24 bp, Homo sapiens
ggctgctcatggatgacctcaagg

SEQ ID NO: 8086 - DNA, 24 bp, Homo sapiens
atctttcttgcctctcgcccatat

SEQ ID NO: 8087 - DNA, 24 bp, Homo sapiens
acagtcaatccttgcccagatgat

SEQ ID NO: 8088 - DNA, 24 bp, Homo sapiens
tccaaggagatatcaggctgctca

SEQ ID NO: 8089 - DNA, 24 bp, Homo sapiens
gcacgaagatccgcactacttgac

SEQ ID NO: 8090 - DNA, 24 bp, Homo sapiens
cagtcagtggaagtggcgggtagt

SEQ ID NO: 8091 - DNA, 24 bp, Homo sapiens
ccaccttctggtacgccacgagac

SEQ ID NO: 8092 - DNA, 24 bp, Homo sapiens
actcttccgaccaacacgcttatg

SEQ ID NO: 8093 - DNA, 24 bp, Homo sapiens
ccaccttctggtacgccacgagac

SEQ ID NO: 8094 - DNA, 24 bp, Homo sapiens
cagtcagtggaagtggcgggtagt

SEQ ID NO: 8095 - DNA, 24 bp, Homo sapiens
accaccttctggtacgccacgaga

SEQ ID NO: 8096 - DNA, 24 bp, Homo sapiens
caccaccttctggtacgccacgag

SEQ ID NO: 8097 - DNA, 24 bp, Homo sapiens
tcaccaccttctggtacgccacga

SEQ ID NO: 8098 - DNA, 24 bp, Homo sapiens
ccaacacgcttatgggcttcggag

SEQ ID NO: 8099 - DNA, 24 bp, Homo sapiens
gttgacttccgacagtacgtgcgt

SEQ ID NO: 8100 - DNA, 24 bp, Homo sapiens
ctgttccggtattttcgaatgcca

SEQ ID NO: 8101 - DNA, 24 bp, Homo sapiens
cctacggcagtgaactggtggaac

SEQ ID NO: 8102 - DNA, 24 bp, Homo sapiens
ggaagtcaccagcatgaaggcgat

SEQ ID NO: 8103 - DNA, 24 bp, Homo sapiens
ccaagcctccagcacctgaagatc

SEQ ID NO: 8104 - DNA, 24 bp, Homo sapiens
atatctttcttgcctctcgcccat

SEQ ID NO: 8105 - DNA, 24 bp, Homo sapiens
tcacaagtggaactacaggcaacc

SEQ ID NO: 8106 - DNA, 24 bp, Homo sapiens
ccaagcctccagcacctgaagatc

SEQ ID NO: 8107 - DNA, 24 bp, Homo sapiens
ccaatgccaagaagaaaaacgcta

SEQ ID NO: 8108 - DNA, 24 bp, Homo sapiens
accaatgccaagaagaaaaacgct

SEQ ID NO: 8109 - DNA, 24 bp, Homo sapiens
taccaatgccaagaagaaaaacgc

SEQ ID NO: 8110 - DNA, 25 bp, Homo sapiens
attgaactgccttggctgtactgct

SEQ ID NO: 8111 - DNA, 25 bp, Homo sapiens
actgctgcttctattattgccttct

SEQ ID NO: 8112 - DNA, 25 bp, Homo sapiens
tgctcaccattattttgctgcctgt

SEQ ID NO: 8113 - DNA, 25 bp, Homo sapiens
ggaagtccatatcgctctgtcacac

SEQ ID NO: 8114 - DNA, 25 bp, Homo sapiens
attgaactgccttggctgtactgct

SEQ ID NO: 8115 - DNA, 25 bp, Homo sapiens
ttgctgcctgtccacttgttaataa

SEQ ID NO: 8116 - DNA, 25 bp, Homo sapiens
ttggctcatgtgctagaactgacag

SEQ ID NO: 8117 - DNA, 25 bp, Homo sapiens
gcaggattggatattcttctccgct

SEQ ID NO: 8118 - DNA, 23 bp, Homo sapiens
ccacacttatggctgctgttccg

SEQ ID NO: 8119 - DNA, 25 bp, Homo sapiens
tgaagttacaagcaggagagtatgt

SEQ ID NO: 8120 - DNA, 25 bp, Homo sapiens
aagctgcactgaagaattgtccact

SEQ ID NO: 8121 - DNA, 25 bp, Homo sapiens
caaggttcgattaagcccagagcca

SEQ ID NO: 8122 - DNA, 24 bp, Homo sapiens
tctctctccagcccagccgaccta

SEQ ID NO: 8123 - DNA, 24 bp, Homo sapiens
ttctctctccagcccagccgacct

SEQ ID NO: 8124 - DNA, 24 bp, Homo sapiens
gttctctctccagcccagccgacc

SEQ ID NO: 8125 - DNA, 24 bp, Homo sapiens
gtcaaattcaggcgttgttcaagt

SEQ ID NO: 8126 - DNA, 24 bp, Homo sapiens
agtcaaattcaggcgttgttcaag

SEQ ID NO: 8127 - DNA, 24 bp, Homo sapiens
cagtcaaattcaggcgttgttcaa

SEQ ID NO: 8128 - DNA, 24 bp, Homo sapiens
ggaacctatggaccttgccaccat

SEQ ID NO: 8129 - DNA, 24 bp, Homo sapiens
aggaacctatggaccttgccacca

SEQ ID NO: 8130 - DNA, 24 bp, Homo sapiens
aaggaacctatggaccttgccacc

SEQ ID NO: 8131 - DNA, 25 bp, Homo sapiens
gactacaacctcacaaccgattcca

SEQ ID NO: 8132 - DNA, 24 bp, Homo sapiens
caagttgcagcacagtctcagcct

SEQ ID NO: 8133 - DNA, 23 bp, Homo sapiens
gccacagactgctcagccttcag

SEQ ID NO: 8134 - DNA, 24 bp, Homo sapiens
cagtgccagtcaacagaggatgcc

SEQ ID NO: 8135 - DNA, 25 bp, Homo sapiens
tgctcacgccactaacagagaagga

SEQ ID NO: 8136 - DNA, 24 bp, Homo sapiens
aggaacctatggaccttgccacca

SEQ ID NO: 8137 - DNA, 25 bp, Homo sapiens
ccagtgtgcagaagttctcgaatca

SEQ ID NO: 8138 - DNA, 25 bp, Homo sapiens
tcgttactacaatccaagtgactcc

SEQ ID NO: 8139 - DNA, 24 bp, Homo sapiens
aggaacctatggaccttgccacca

SEQ ID NO: 8140 - DNA, 25 bp, Homo sapiens
gcgtctaccacaatcaatactccac

SEQ ID NO: 8141 - DNA, 24 bp, Homo sapiens
aagcaccagcacagagaagaccat

SEQ ID NO: 8142 - DNA, 24 bp, Homo sapiens
aagttctgtctgactccagcagga

SEQ ID NO: 8143 - DNA, 25 bp, Homo sapiens
agaagaaacgatgcagcaagcgaca

SEQ ID NO: 8144 - DNA, 25 bp, Homo sapiens
acacatttccagttaagcatcaggt

SEQ ID NO: 8145 - DNA, 25 bp, Homo sapiens
agtgacaggatatggtggttggagc

SEQ ID NO: 8146 - DNA, 25 bp, Homo sapiens
gagatgttggtccttatggcattcg

SEQ ID NO: 8147 - DNA, 25 bp, Homo sapiens
agcagaagaagaactggaattgtgg

SEQ ID NO: 8148 - DNA, 23 bp, Homo sapiens
gcacaagcagttgagcaacaggc

SEQ ID NO: 8149 - DNA, 25 bp, Homo sapiens
agcagaagaagaactggaattgtgg

SEQ ID NO: 8150 - DNA, 23 bp, Homo sapiens
gcacaagcagttgagcaacaggc

SEQ ID NO: 8151 - DNA, 24 bp, Homo sapiens
gagcagcagaagccgacagtgatt

SEQ ID NO: 8152 - DNA, 25 bp, Homo sapiens
tccttgaaccagtagaccctaatga

SEQ ID NO: 8153 - DNA, 25 bp, Homo sapiens
tgctcacgccactaacagagaagga

SEQ ID NO: 8154 - DNA, 24 bp, Homo sapiens
cagtgccagtcaacagaggatgcc

SEQ ID NO: 8155 - DNA, 25 bp, Homo sapiens
ggctgtgatcggtgtcagaattggt

SEQ ID NO: 8156 - DNA, 25 bp, Homo sapiens
tcgttactacaatccaagtgactcc

SEQ ID NO: 8157 - DNA, 25 bp, Homo sapiens
accagtgtgcagaagttctcgaatc

SEQ ID NO: 8158 - DNA, 25 bp, Homo sapiens
acacagcaagaatctggttgtctga

SEQ ID NO: 8159 - DNA, 25 bp, Homo sapiens
gacggaatttgtggcagatatgacc

SEQ ID NO: 8160 - DNA, 24 bp, Homo sapiens
tgactccccattttaccagtgtgc

SEQ ID NO: 8161 - DNA, 25 bp, Homo sapiens
aaagagtacaaagacgatattatga

SEQ ID NO: 8162 - DNA, 24 bp, Homo sapiens
ctggcccgtgctggaaaagtgaga

SEQ ID NO: 8163 - DNA, 24 bp, Homo sapiens
tcacccaacagattctgtgtccga

SEQ ID NO: 8164 - DNA, 24 bp, Homo sapiens
ttcacccaacagattctgtgtccg

SEQ ID NO: 8165 - DNA, 24 bp, Homo sapiens
cttcacccaacagattctgtgtcc

SEQ ID NO: 8166 - DNA, 23 bp, Homo sapiens
catgacaacagccaggaacctcc

SEQ ID NO: 8167 - DNA, 25 bp, Homo sapiens
tggttgcccgtattcttcctttcct

SEQ ID NO: 8168 - DNA, 23 bp, Homo sapiens
gtctggaagaagagcgacctgcc

SEQ ID NO: 8169 - DNA, 25 bp, Homo sapiens
caatgccacctcgttatcctgctcc

SEQ ID NO: 8170 - DNA, 25 bp, Homo sapiens
cctcctagtgttcctcctgttctca

SEQ ID NO: 8171 - DNA, 23 bp, Homo sapiens
ctacaccacctccacagcagcac

SEQ ID NO: 8172 - DNA, 25 bp, Homo sapiens
cctcctagtgttcctcctgttctca

SEQ ID NO: 8173 - DNA, 25 bp, Homo sapiens
ggtagtccacttgctgccatgaatc

SEQ ID NO: 8174 - DNA, 23 bp, Homo sapiens
ctacaccacctccacagcagcac

SEQ ID NO: 8175 - DNA, 24 bp, Homo sapiens
tggtgcgggagatagaggaagtca

SEQ ID NO: 8176 - DNA, 25 bp, Homo sapiens
atatgccaatctcatgttgcagcgg

SEQ ID NO: 8177 - DNA, 23 bp, Homo sapiens
cagtcatcaagatcatctccgaa

SEQ ID NO: 8178 - DNA, 23 bp, Homo sapiens
gtctggaagaagagcgacctgcc

SEQ ID NO: 8179 - DNA, 25 bp, Homo sapiens
gctgttgtgacatctcggagtgagg

SEQ ID NO: 8180 - DNA, 23 bp, Homo sapiens
tggagcacgcctataagccagtg

SEQ ID NO: 8181 - DNA, 23 bp, Homo sapiens
cgacaggctgctctcttgacgac

SEQ ID NO: 8182 - DNA, 23 bp, Homo sapiens
agactgtgtggactcctgccctc

SEQ ID NO: 8183 - DNA, 24 bp, Homo sapiens
gcacctacacaggcagaatcttct

SEQ ID NO: 8184 - DNA, 24 bp, Homo sapiens
ctggggaccctgccctcctcccag

SEQ ID NO: 8185 - DNA, 24 bp, Homo sapiens
cctggggaccctgccctcctccca

SEQ ID NO: 8186 - DNA, 24 bp, Homo sapiens
ccctggggaccctgccctcctccc

SEQ ID NO: 8187 - DNA, 24 bp, Homo sapiens
atctggggaaggaagtgcgctgga

SEQ ID NO: 8188 - DNA, 24 bp, Homo sapiens
aatctggggaaggaagtgcgctgg

SEQ ID NO: 8189 - DNA, 24 bp, Homo sapiens
gaatctggggaaggaagtgcgctg

SEQ ID NO: 8190 - DNA, 25 bp, Homo sapiens
gcttactacgacctctgcctcctgg

SEQ ID NO: 8191 - DNA, 23 bp, Homo sapiens
gggactacaggcactcaccacca

SEQ ID NO: 8192 - DNA, 23 bp, Homo sapiens
cttttcgcctgcctcagcctcct

SEQ ID NO: 8193 - DNA, 23 bp, Homo sapiens
tacagtggcacgatctcggctca

SEQ ID NO: 8194 - DNA, 23 bp, Homo sapiens
cgggttcaagcgattctcctgcc

SEQ ID NO: 8195 - DNA, 24 bp, Homo sapiens
tcctgagtagctgggactacaggc

SEQ ID NO: 8196 - DNA, 24 bp, Homo sapiens
ggagtggaatggaacctatcactg

SEQ ID NO: 8197 - DNA, 24 bp, Homo sapiens
gggagtggaatggaacctatcact

SEQ ID NO: 8198 - DNA, 24 bp, Homo sapiens
agggagtggaatggaacctatcac

SEQ ID NO: 8199 - DNA, 24 bp, Homo sapiens
aggtgatgcaggtgaatatgtttg

SEQ ID NO: 8200 - DNA, 24 bp, Homo sapiens
caggtgatgcaggtgaatatgttt

SEQ ID NO: 8201 - DNA, 24 bp, Homo sapiens
ccaggtgatgcaggtgaatatgtt

SEQ ID NO: 8202 - DNA, 23 bp, Homo sapiens
aattccacgttacgagctgctgc

SEQ ID NO: 8203 - DNA, 23 bp, Homo sapiens
agtacatccagaagctgccagcc

SEQ ID NO: 8204 - DNA, 23 bp, Homo sapiens
gcctgaccctgcagcaccacatg

SEQ ID NO: 8205 - DNA, 23 bp, Homo sapiens
gccttccaagcagccattgacca

SEQ ID NO: 8206 - DNA, 23 bp, Homo sapiens
gtgtgtgccaggtgctccgacta

SEQ ID NO: 8207 - DNA, 23 bp, Homo sapiens
accgagtctgcctccactgctac

SEQ ID NO: 8208 - DNA, 24 bp, Homo sapiens
tcccgccccaggtcgtcctctcag

SEQ ID NO: 8209 - DNA, 24 bp, Homo sapiens
ctcccgccccaggtcgtcctctca

SEQ ID NO: 8210 - DNA, 24 bp, Homo sapiens
cctcccgccccaggtcgtcctctc

SEQ ID NO: 8211 - DNA, 24 bp, Homo sapiens
cctctgtccaggtgagcacctccg

SEQ ID NO: 8212 - DNA, 24 bp, Homo sapiens
tcctctgtccaggtgagcacctcc

SEQ ID NO: 8213 - DNA, 24 bp, Homo sapiens
ctcctctgtccaggtgagcacctc

SEQ ID NO: 8214 - DNA, 24 bp, Homo sapiens
ccaaagtgcagggattacaggcgt

SEQ ID NO: 8215 - DNA, 23 bp, Homo sapiens
gctacctgtcctctgccactcca

SEQ ID NO: 8216 - DNA, 23 bp, Homo sapiens
ctccacctcctgctgccaacctg

SEQ ID NO: 8217 - DNA, 23 bp, Homo sapiens
atggtgtactcggcggtcaaggt

SEQ ID NO: 8218 - DNA, 24 bp, Homo sapiens
ccagtttctgtgtcagcatcccga

SEQ ID NO: 8219 - DNA, 24 bp, Homo sapiens
ctcctgggctcttcaatgtggtgc

SEQ ID NO: 8220 - DNA, 24 bp, Homo sapiens
ttcagattgcctcttggaagtcgg

SEQ ID NO: 8221 - DNA, 24 bp, Homo sapiens
ctgcacacccgtcccctctgtttc

SEQ ID NO: 8222 - DNA, 24 bp, Homo sapiens
cctgcacacccgtcccctctgttt

SEQ ID NO: 8223 - DNA, 24 bp, Homo sapiens
ccctgcacacccgtcccctctgtt

SEQ ID NO: 8224 - DNA, 24 bp, Homo sapiens
tccccacccaggtttacatcccca

SEQ ID NO: 8225 - DNA, 24 bp, Homo sapiens
ttccccacccaggtttacatcccc

SEQ ID NO: 8226 - DNA, 24 bp, Homo sapiens
cttccccacccaggtttacatccc

SEQ ID NO: 8227 - DNA, 24 bp, Homo sapiens
ctatgatccactgcagttccaggg

SEQ ID NO: 8228 - DNA, 24 bp, Homo sapiens
actatgatccactgcagttccagg

SEQ ID NO: 8229 - DNA, 24 bp, Homo sapiens
tactatgatccactgcagttccag

SEQ ID NO: 8230 - DNA, 25 bp, Homo sapiens
ttgaaggtgatgctgttctctcgga

SEQ ID NO: 8231 - DNA, 24 bp, Homo sapiens
gctgaggagtcggagtgtgagagt

SEQ ID NO: 8232 - DNA, 23 bp, Homo sapiens
cttcatctgcggcgggtggagag

SEQ ID NO: 8233 - DNA, 25 bp, Homo sapiens
ctattcatcccagcggcaaagacct

SEQ ID NO: 8234 - DNA, 25 bp, Homo sapiens
gcagttccagggaccaatctatacc

SEQ ID NO: 8235 - DNA, 23 bp, Homo sapiens
gacagccaccacctcagcagttg

SEQ ID NO: 8236 - DNA, 23 bp, Homo sapiens
accagctcctctgcccaatccag

SEQ ID NO: 8237 - DNA, 23 bp, Homo sapiens
gacagccaccacctcagcagttg

SEQ ID NO: 8238 - DNA, 25 bp, Homo sapiens
aatcccagttacccttatgctccag

SEQ ID NO: 8239 - DNA, 25 bp, Homo sapiens
cttgtgcagccaggaatgaaccttc

SEQ ID NO: 8240 - DNA, 23 bp, Homo sapiens
gacagccaccacctcagcagttg

SEQ ID NO: 8241 - DNA, 25 bp, Homo sapiens
aatcccagttacccttatgctccag

SEQ ID NO: 8242 - DNA, 23 bp, Homo sapiens
gacagccaccacctcagcagttg

SEQ ID NO: 8243 - DNA, 25 bp, Homo sapiens
ccaccaccgcctcatctgtatccta

SEQ ID NO: 8244 - DNA, 23 bp, Homo sapiens
cccagccagtcaccatcaagccc

SEQ ID NO: 8245 - DNA, 25 bp, Homo sapiens
aatcccagttacccttatgctccag

SEQ ID NO: 8246 - DNA, 23 bp, Homo sapiens
gacagccaccacctcagcagttg

SEQ ID NO: 8247 - DNA, 25 bp, Homo sapiens
gcagttccagggaccaatctatacc

SEQ ID NO: 8248 - DNA, 25 bp, Homo sapiens
ccaccaccgcctcatctgtatccta

SEQ ID NO: 8249 - DNA, 25 bp, Homo sapiens
aatcccagttacccttatgctccag

SEQ ID NO: 8250 - DNA, 23 bp, Homo sapiens
gacagccaccacctcagcagttg

SEQ ID NO: 8251 - DNA, 23 bp, Homo sapiens
tttgcctccaccattcccaccca

SEQ ID NO: 8252 - DNA, 25 bp, Homo sapiens
ccttaaaccctctgcctttgaaagt

SEQ ID NO: 8253 - DNA, 25 bp, Homo sapiens
gcaatgctggacactacaggtatct

SEQ ID NO: 8254 - DNA, 24 bp, Homo sapiens
acttatgtcaaatatgaggcccca

SEQ ID NO: 8255 - DNA, 24 bp, Homo sapiens
aacttatgtcaaatatgaggcccc

SEQ ID NO: 8256 - DNA, 24 bp, Homo sapiens
aaacttatgtcaaatatgaggccc

SEQ ID NO: 8257 - DNA, 24 bp, Homo sapiens
agaagggaaagcatgatgaacttg

SEQ ID NO: 8258 - DNA, 24 bp, Homo sapiens
aagaagggaaagcatgatgaactt

SEQ ID NO: 8259 - DNA, 24 bp, Homo sapiens
aaagaagggaaagcatgatgaact

SEQ ID NO: 8260 - DNA, 25 bp, Homo sapiens
gcagttggtgaagttgaggatagca

SEQ ID NO: 8261 - DNA, 25 bp, Homo sapiens
gacttcctccctcatttgccatcgt

SEQ ID NO: 8262 - DNA, 25 bp, Homo sapiens
tgttgagaggagcattgatgactgg

SEQ ID NO: 8263 - DNA, 25 bp, Homo sapiens
ccaagccatcaataacgccatcagc

SEQ ID NO: 8264 - DNA, 23 bp, Homo sapiens
cttggtccagacaccgcctgctc

SEQ ID NO: 8265 - DNA, 25 bp, Homo sapiens
gagatggttccagttatcagcagca

SEQ ID NO: 8266 - DNA, 25 bp, Homo sapiens
aattcactggtccacaagcggtctc

SEQ ID NO: 8267 - DNA, 23 bp, Homo sapiens
gctagatggtcagatggcttgtt

SEQ ID NO: 8268 - DNA, 25 bp, Homo sapiens
ccaacatccttgaccaagctgtctt

SEQ ID NO: 8269 - DNA, 25 bp, Homo sapiens
aagatatgagcatgttctggaggca

SEQ ID NO: 8270 - DNA, 24 bp, Homo sapiens
aattcgtgttcctcctgtgccacc

SEQ ID NO: 8271 - DNA, 25 bp, Homo sapiens
agcagagaaagaacctgaaggaaca

SEQ ID NO: 8272 - DNA, 24 bp, Homo sapiens
aaggccagcaggtgagcggttttt

SEQ ID NO: 8273 - DNA, 24 bp, Homo sapiens
caaggccagcaggtgagcggtttt

SEQ ID NO: 8274 - DNA, 24 bp, Homo sapiens
tcaaggccagcaggtgagcggttt

SEQ ID NO: 8275 - DNA, 25 bp, Homo sapiens
cggttcctcctcctggattcagtcc

SEQ ID NO: 8276 - DNA, 25 bp, Homo sapiens
tttaacccttcacaaccaccacctg

SEQ ID NO: 8277 - DNA, 25 bp, Homo sapiens
acgattccaccagtagtaccaacat

SEQ ID NO: 8278 - DNA, 25 bp, Homo sapiens
agatagcagaacaactacaacagca

SEQ ID NO: 8279 - DNA, 24 bp, Homo sapiens
ctcttggagcagcaacagcctcaa

SEQ ID NO: 8280 - DNA, 25 bp, Homo sapiens
gtcagagcattcagcgtcaccatca

SEQ ID NO: 8281 - DNA, 25 bp, Homo sapiens
aagactctgagcatagtgaagaacc

SEQ ID NO: 8282 - DNA, 24 bp, Homo sapiens
ctcttggagcagcaacagcctcaa

SEQ ID NO: 8283 - DNA, 25 bp, Homo sapiens
gtcagagcattcagcgtcaccatca

SEQ ID NO: 8284 - DNA, 25 bp, Homo sapiens
ggcaagatggagtggaagaggaggt

SEQ ID NO: 8285 - DNA, 25 bp, Homo sapiens
tgaagagacaccgcagaactcacac

SEQ ID NO: 8286 - DNA, 25 bp, Homo sapiens
acaaggagaagtgctttcgggtgac

SEQ ID NO: 8287 - DNA, 24 bp, Homo sapiens
gaatgtgccacctgctgtccagat

SEQ ID NO: 8288 - DNA, 24 bp, Homo sapiens
tttctggctgggattgcaggcgtg

SEQ ID NO: 8289 - DNA, 24 bp, Homo sapiens
atttctggctgggattgcaggcgt

SEQ ID NO: 8290 - DNA, 24 bp, Homo sapiens
aatttctggctgggattgcaggcg

SEQ ID NO: 8291 - DNA, 24 bp, Homo sapiens
tcaggctgcaggatccagcaatca

SEQ ID NO: 8292 - DNA, 24 bp, Homo sapiens
ctcaggctgcaggatccagcaatc

SEQ ID NO: 8293 - DNA, 24 bp, Homo sapiens
cctcaggctgcaggatccagcaat

SEQ ID NO: 8294 - DNA, 24 bp, Homo sapiens
aggagccagcgattcaagccccag

SEQ ID NO: 8295 - DNA, 24 bp, Homo sapiens
caggagccagcgattcaagcccca

SEQ ID NO: 8296 - DNA, 24 bp, Homo sapiens
ccaggagccagcgattcaagcccc

SEQ ID NO: 8297 - DNA, 23 bp, Homo sapiens
ggctgacttggatgacttggatt

SEQ ID NO: 8298 - DNA, 25 bp, Homo sapiens
cctccacaacaagcatccacagtcg

SEQ ID NO: 8299 - DNA, 23 bp, Homo sapiens
aagcagaggtctccaggacagat

SEQ ID NO: 8300 - DNA, 23 bp, Homo sapiens
cgctcagccagagaagacgagtg

SEQ ID NO: 8301 - DNA, 25 bp, Homo sapiens
gcctgttacttggagttcctgaaga

SEQ ID NO: 8302 - DNA, 25 bp, Homo sapiens
cactgttctctgcctgcctgatacc

SEQ ID NO: 8303 - DNA, 24 bp, Homo sapiens
ctttgtaagaccctgagacgccct

SEQ ID NO: 8304 - DNA, 25 bp, Homo sapiens
gctggacctaagtggaaactcgctg

SEQ ID NO: 8305 - DNA, 23 bp, Homo sapiens
ccgtcctcaaggtcaccagaaac

SEQ ID NO: 8306 - DNA, 25 bp, Homo sapiens
atggaaggaggagcaagtcaataga

SEQ ID NO: 8307 - DNA, 25 bp, Homo sapiens
agaggaggaatatcaaagggtccga

SEQ ID NO: 8308 - DNA, 23 bp, Homo sapiens
atatttgcccgagagactggcca

SEQ ID NO: 8309 - DNA, 23 bp, Homo sapiens
cagagcagcacagacagcgaact

SEQ ID NO: 8310 - DNA, 23 bp, Homo sapiens
ggtgacagcatcggcagcagtaa

SEQ ID NO: 8311 - DNA, 23 bp, Homo sapiens
cagcagcagcagcagcaacttcc

SEQ ID NO: 8312 - DNA, 23 bp, Homo sapiens
cagtgcgggaaggatctccaggc

SEQ ID NO: 8313 - DNA, 23 bp, Homo sapiens
ggtgacagcatcggcagcagtaa

SEQ ID NO: 8314 - DNA, 25 bp, Homo sapiens
ccttggagcagcacagactctgatg

SEQ ID NO: 8315 - DNA, 24 bp, Homo sapiens
agtcgccaaggttctactgaagca

SEQ ID NO: 8316 - DNA, 24 bp, Homo sapiens
cccacttatctcccagcaccctca

SEQ ID NO: 8317 - DNA, 24 bp, Homo sapiens
gcaccacctactcagcaagttctg

SEQ ID NO: 8318 - DNA, 23 bp, Homo sapiens
cagcagcagcagcagcaacttcc

SEQ ID NO: 8319 - DNA, 24 bp, Homo sapiens
tctcacaggcagatgacctcagca

SEQ ID NO: 8320 - DNA, 24 bp, Homo sapiens
agtcgccaaggttctactgaagca

SEQ ID NO: 8321 - DNA, 25 bp, Homo sapiens
tttgagagtgctgttgacctttgtt

SEQ ID NO: 8322 - DNA, 25 bp, Homo sapiens
gccatagcaggtggacaagaactct

SEQ ID NO: 8323 - DNA, 25 bp, Homo sapiens
gtggtgatgaagaactggaaagaga

SEQ ID NO: 8324 - DNA, 23 bp, Homo sapiens
tgcccttcccagccatccacctg

SEQ ID NO: 8325 - DNA, 23 bp, Homo sapiens
gtcactacctggagtaacaaaac

SEQ ID NO: 8326 - DNA, 25 bp, Homo sapiens
aaggaagtagatcgtacagccatgc

SEQ ID NO: 8327 - DNA, 23 bp, Homo sapiens
cggcggcgaatgctgggagagtc

SEQ ID NO: 8328 - DNA, 23 bp, Homo sapiens
ggcgtggctgcggctgcggctgc

SEQ ID NO: 8329 - DNA, 24 bp, Homo sapiens
agatgtctctggagttctgattgc

SEQ ID NO: 8330 - DNA, 24 bp, Homo sapiens
cagtgagagccttggatgtgaaca

SEQ ID NO: 8331 - DNA, 25 bp, Homo sapiens
agactaatctggtagcttctggtgc

SEQ ID NO: 8332 - DNA, 25 bp, Homo sapiens
tctggagttctgattgcaggtggtg

SEQ ID NO: 8333 - DNA, 25 bp, Homo sapiens
tggagacaaggaagttgtgattgcc

SEQ ID NO: 8334 - DNA, 24 bp, Homo sapiens
caagcatactggcccagtgagagc

SEQ ID NO: 8335 - DNA, 25 bp, Homo sapiens
aggaagttgtgattgcccagaatga

SEQ ID NO: 8336 - DNA, 24 bp, Homo sapiens
agatgtctctggagttctgattgc

SEQ ID NO: 8337 - DNA, 24 bp, Homo sapiens
tgccacattctcctcttctcacag

SEQ ID NO: 8338 - DNA, 25 bp, Homo sapiens
tcctcagccgatcagaccaacttca

SEQ ID NO: 8339 - DNA, 23 bp, Homo sapiens
ctgagcagcagcagcagcagcac

SEQ ID NO: 8340 - DNA, 25 bp, Homo sapiens
cgtttgagaatgtcagaatgccttc

SEQ ID NO: 8341 - DNA, 23 bp, Homo sapiens
gaggagagccctgctgctgaaga

SEQ ID NO: 8342 - DNA, 25 bp, Homo sapiens
cttgggagagcacattaaagaggaa

SEQ ID NO: 8343 - DNA, 25 bp, Homo sapiens
tttgagagtgctgttgacctttgtt

SEQ ID NO: 8344 - DNA, 25 bp, Homo sapiens
accaagaggaagctagatgatgcca

SEQ ID NO: 8345 - DNA, 25 bp, Homo sapiens
aactactcagaaggattgaccatgc

SEQ ID NO: 8346 - DNA, 24 bp, Homo sapiens
accagcaacttcagtgagacctct

SEQ ID NO: 8347 - DNA, 25 bp, Homo sapiens
aactactcagaaggattgaccatgc

SEQ ID NO: 8348 - DNA, 24 bp, Homo sapiens
accagcaacttcagtgagacctct

SEQ ID NO: 8349 - DNA, 25 bp, Homo sapiens
ttctcaaagttgttctcacccaggc

SEQ ID NO: 8350 - DNA, 24 bp, Homo sapiens
gaaagaagaagcggccacacagtc

SEQ ID NO: 8351 - DNA, 24 bp, Homo sapiens
agaaagaagaagcggccacacagt

SEQ ID NO: 8352 - DNA, 24 bp, Homo sapiens
gagaaagaagaagcggccacacag

SEQ ID NO: 8353 - DNA, 25 bp, Homo sapiens
aacgagtcttcactacccagaatca

SEQ ID NO: 8354 - DNA, 25 bp, Homo sapiens
aggctgatgtagatgtcatagttga

SEQ ID NO: 8355 - DNA, 25 bp, Homo sapiens
tggatcattcacatggcttggacaa

SEQ ID NO: 8356 - DNA, 25 bp, Homo sapiens
tcagaaacaggagccaccagaaatg

SEQ ID NO: 8357 - DNA, 25 bp, Homo sapiens
aacgagtcttcactacccagaatca

SEQ ID NO: 8358 - DNA, 25 bp, Homo sapiens
tggatcattcacatggcttggacaa

SEQ ID NO: 8359 - DNA, 24 bp, Homo sapiens
gggaggccgaggtgggtggatcac

SEQ ID NO: 8360 - DNA, 24 bp, Homo sapiens
tgggaggccgaggtgggtggatca

SEQ ID NO: 8361 - DNA, 24 bp, Homo sapiens
ttgggaggccgaggtgggtggatc

SEQ ID NO: 8362 - DNA, 24 bp, Homo sapiens
cccgttcgcaggtaggacatgggg

SEQ ID NO: 8363 - DNA, 24 bp, Homo sapiens
acccgttcgcaggtaggacatggg

SEQ ID NO: 8364 - DNA, 24 bp, Homo sapiens
cacccgttcgcaggtaggacatgg

SEQ ID NO: 8365 - DNA, 24 bp, Homo sapiens
tgggtggcaaggtgcggccgcggg

SEQ ID NO: 8366 - DNA, 24 bp, Homo sapiens
ctgggtggcaaggtgcggccgcgg

SEQ ID NO: 8367 - DNA, 24 bp, Homo sapiens
cctgggtggcaaggtgcggccgcg

SEQ ID NO: 8368 - DNA, 24 bp, Homo sapiens
gttatacaccggtgacaagccatc

SEQ ID NO: 8369 - DNA, 24 bp, Homo sapiens
agttatacaccggtgacaagccat

SEQ ID NO: 8370 - DNA, 24 bp, Homo sapiens
tagttatacaccggtgacaagcca

SEQ ID NO: 8371 - DNA, 25 bp, Homo sapiens
aactctggcaatcaacactgtgact

SEQ ID NO: 8372 - DNA, 25 bp, Homo sapiens
ccacgcagtagccttaacaacagtc

SEQ ID NO: 8373 - DNA, 25 bp, Homo sapiens
cggtgacaagccatccagaatcagt

SEQ ID NO: 8374 - DNA, 25 bp, Homo sapiens
ccacgcagtagccttaacaacagtc

SEQ ID NO: 8375 - DNA, 25 bp, Homo sapiens
cggtgacaagccatccagaatcagt

SEQ ID NO: 8376 - DNA, 25 bp, Homo sapiens
cattaactcctcagcagcaaccaca

SEQ ID NO: 8377 - DNA, 25 bp, Homo sapiens
gaaggaagatgtgctgcctactcgg

SEQ ID NO: 8378 - DNA, 25 bp, Homo sapiens
aactctggcaatcaacactgtgact

SEQ ID NO: 8379 - DNA, 25 bp, Homo sapiens
ccacgcagtagccttaacaacagtc

SEQ ID NO: 8380 - DNA, 24 bp, Homo sapiens
gcaccatccgaaccatcagcatca

SEQ ID NO: 8381 - DNA, 23 bp, Homo sapiens
acacagccatctccacatcctcc

SEQ ID NO: 8382 - DNA, 25 bp, Homo sapiens
ctcaacaccacaggcagtaattcgg

SEQ ID NO: 8383 - DNA, 24 bp, Homo sapiens
caaggcggagagtgacggagtcgg

SEQ ID NO: 8384 - DNA, 24 bp, Homo sapiens
ctgctgggcgggctgaagggttag

SEQ ID NO: 8385 - DNA, 24 bp, Homo sapiens
agtctcgggcggcggtgtccggcg

SEQ ID NO: 8386 - DNA, 24 bp, Homo sapiens
tggaaaccatgccaggacatcaca

SEQ ID NO: 8387 - DNA, 24 bp, Homo sapiens
gtggaaaccatgccaggacatcac

SEQ ID NO: 8388 - DNA, 24 bp, Homo sapiens
agtggaaaccatgccaggacatca

SEQ ID NO: 8389 - DNA, 25 bp, Homo sapiens
tcaaggaaccagaactgatgtggct

SEQ ID NO: 8390 - DNA, 25 bp, Homo sapiens
tgagacctacattcctagtgagcaa

SEQ ID NO: 8391 - DNA, 25 bp, Homo sapiens
aggagaggtgtttgagcccagatga

SEQ ID NO: 8392 - DNA, 24 bp, Homo sapiens
ggaccatcaaggaaccttcaaaga

SEQ ID NO: 8393 - DNA, 24 bp, Homo sapiens
tggaccatcaaggaaccttcaaag

SEQ ID NO: 8394 - DNA, 24 bp, Homo sapiens
atggaccatcaaggaaccttcaaa

SEQ ID NO: 8395 - DNA, 23 bp, Homo sapiens
acctcaacattgtggagcagccg

SEQ ID NO: 8396 - DNA, 23 bp, Homo sapiens
agcaacccagttcatccagcgtg

SEQ ID NO: 8397 - DNA, 24 bp, Homo sapiens
cttcctgctctatgtggctctggc

SEQ ID NO: 8398 - DNA, 23 bp, Homo sapiens
acctcaacattgtggagcagccg

SEQ ID NO: 8399 - DNA, 25 bp, Homo sapiens
gccttgcccagaagtatgctgagaa

SEQ ID NO: 8400 - DNA, 23 bp, Homo sapiens
ttacactgacgtggccctccctc

SEQ ID NO: 8401 - DNA, 23 bp, Homo sapiens
cactggagccaccgcacaatctg

SEQ ID NO: 8402 - DNA, 23 bp, Homo sapiens
cttcacagcagcctgcctccagt

SEQ ID NO: 8403 - DNA, 25 bp, Homo sapiens
ccgtgtctgtctctgggtcctttga

SEQ ID NO: 8404 - DNA, 25 bp, Homo sapiens
gaagactgtcagagcctggtgaagc

SEQ ID NO: 8405 - DNA, 23 bp, Homo sapiens
agatcttctctgaggtgacgccc

SEQ ID NO: 8406 - DNA, 24 bp, Homo sapiens
ccaccgctgccttcaacctatctg

SEQ ID NO: 8407 - DNA, 25 bp, Homo sapiens
agcacgacattgagactattgagga

SEQ ID NO: 8408 - DNA, 25 bp, Homo sapiens
tgacgaacagagtaccaccaacact

SEQ ID NO: 8409 - DNA, 25 bp, Homo sapiens
ccagcagtcaacagcatcacctacg

SEQ ID NO: 8410 - DNA, 25 bp, Homo sapiens
acagactcacttgtcactcactgcc

SEQ ID NO: 8411 - DNA, 23 bp, Homo sapiens
tacagccacagccacgacaggta

SEQ ID NO: 8412 - DNA, 25 bp, Homo sapiens
actcacttgtcactcactgccatag

SEQ ID NO: 8413 - DNA, 25 bp, Homo sapiens
ccagcagtcaacagcatcacctacg

SEQ ID NO: 8414 - DNA, 25 bp, Homo sapiens
gataagaagaaggtccagcaactcc

SEQ ID NO: 8415 - DNA, 24 bp, Homo sapiens
ccctgcccccggacgtgaccacgc

SEQ ID NO: 8416 - DNA, 24 bp, Homo sapiens
gccctgcccccggacgtgaccacg

SEQ ID NO: 8417 - DNA, 24 bp, Homo sapiens
tgccctgcccccggacgtgaccac

SEQ ID NO: 8418 - DNA, 24 bp, Homo sapiens
cacatgatgtgctctctctcccac

SEQ ID NO: 8419 - DNA, 24 bp, Homo sapiens
ccacatgatgtgctctctctccca

SEQ ID NO: 8420 - DNA, 24 bp, Homo sapiens
tccacatgatgtgctctctctccc

SEQ ID NO: 8421 - DNA, 24 bp, Homo sapiens
tcctcctgcagctttgggaactac

SEQ ID NO: 8422 - DNA, 24 bp, Homo sapiens
ttcctcctgcagctttgggaacta

SEQ ID NO: 8423 - DNA, 24 bp, Homo sapiens
tttcctcctgcagctttgggaact

SEQ ID NO: 8424 - DNA, 24 bp, Homo sapiens
tgcagtgcctcattcagccatgct

SEQ ID NO: 8425 - DNA, 24 bp, Homo sapiens
ttgcagtgcctcattcagccatgc

SEQ ID NO: 8426 - DNA, 24 bp, Homo sapiens
tttgcagtgcctcattcagccatg

SEQ ID NO: 8427 - DNA, 23 bp, Homo sapiens
ggagcctgagcacacggagtagt

SEQ ID NO: 8428 - DNA, 25 bp, Homo sapiens
gtgggaggaagaaagagtgctgtgc

SEQ ID NO: 8429 - DNA, 25 bp, Homo sapiens
gagagcatcctgtcagagcatgagg

SEQ ID NO: 8430 - DNA, 24 bp, Homo sapiens
caacacgacggacttctagcacaa

SEQ ID NO: 8431 - DNA, 23 bp, Homo sapiens
cgagtgttgagcctggacagtgg

SEQ ID NO: 8432 - DNA, 25 bp, Homo sapiens
gccaaagagggagaggtgctagatg

SEQ ID NO: 8433 - DNA, 25 bp, Homo sapiens
gccttcttctctactccactgaacc

SEQ ID NO: 8434 - DNA, 25 bp, Homo sapiens
ccgacctgtgaaattctgggagaga

SEQ ID NO: 8435 - DNA, 23 bp, Homo sapiens
ttgcagtgcctcattcagccatg

SEQ ID NO: 8436 - DNA, 25 bp, Homo sapiens
agagataggcaatggtctggtcact

SEQ ID NO: 8437 - DNA, 25 bp, Homo sapiens
tccttgcctctgactatctcaatgc

SEQ ID NO: 8438 - DNA, 25 bp, Homo sapiens
gcctctgtggtgatttgctactagg

SEQ ID NO: 8439 - DNA, 25 bp, Homo sapiens
gccttcttctctactccactgaacc

SEQ ID NO: 8440 - DNA, 23 bp, Homo sapiens
ttgcagtgcctcattcagccatg

SEQ ID NO: 8441 - DNA, 25 bp, Homo sapiens
tcatcacttcatatgtccgacctgt

SEQ ID NO: 8442 - DNA, 25 bp, Homo sapiens
gccattactgaaggtgtagaggaag

SEQ ID NO: 8443 - DNA, 25 bp, Homo sapiens
agtcacaaagtacattctggagggt

SEQ ID NO: 8444 - DNA, 25 bp, Homo sapiens
acagtgctgcttctatgcttcaagt

SEQ ID NO: 8445 - DNA, 25 bp, Homo sapiens
cctaagccttcaagatggtcagcaa

SEQ ID NO: 8446 - DNA, 23 bp, Homo sapiens
tccacagcccaggtcaaagtcca

SEQ ID NO: 8447 - DNA, 23 bp, Homo sapiens
gtgctagtgcctccttgctggtg

SEQ ID NO: 8448 - DNA, 25 bp, Homo sapiens
gccaaagagggagaggtgctagatg

SEQ ID NO: 8449 - DNA, 23 bp, Homo sapiens
ccgagtgttgagcctggacagtg

SEQ ID NO: 8450 - DNA, 24 bp, Homo sapiens
gcaacacgacggacttctagcaca

SEQ ID NO: 8451 - DNA, 25 bp, Homo sapiens
ggagcaacaggacattgatctaagc

SEQ ID NO: 8452 - DNA, 25 bp, Homo sapiens
gctgtcatcctggctattctcgtgg

SEQ ID NO: 8453 - DNA, 24 bp, Homo sapiens
tccagttctgcctcgtcatagcca

SEQ ID NO: 8454 - DNA, 25 bp, Homo sapiens
gagcaacaggacattgatctaagcc

SEQ ID NO: 8455 - DNA, 25 bp, Homo sapiens
gctgtggattggcattaactttgac

SEQ ID NO: 8456 - DNA, 23 bp, Homo sapiens
gcccaacagaagaagctgcccaa

SEQ ID NO: 8457 - DNA, 25 bp, Homo sapiens
tgaaccagcagcaagaagagcatcc

SEQ ID NO: 8458 - DNA, 24 bp, Homo sapiens
cgctgtatgagactggtggctgtg

SEQ ID NO: 8459 - DNA, 23 bp, Homo sapiens
gctcagtgctagtgcctccttgc

SEQ ID NO: 8460 - DNA, 25 bp, Homo sapiens
tgttgcggtcttatttggctcttgg

SEQ ID NO: 8461 - DNA, 23 bp, Homo sapiens
ggtaatgccactacaagcctgct

SEQ ID NO: 8462 - DNA, 24 bp, Homo sapiens
gcagtgtcttaccatctcagccga

SEQ ID NO: 8463 - DNA, 23 bp, Homo sapiens
ggtaatgccactacaagcctgct

SEQ ID NO: 8464 - DNA, 24 bp, Homo sapiens
gcagtgtcttaccatctcagccga

SEQ ID NO: 8465 - DNA, 25 bp, Homo sapiens
agtgagcgattacagtctgacctgg

SEQ ID NO: 8466 - DNA, 24 bp, Homo sapiens
gcagtgtcttaccatctcagccga

SEQ ID NO: 8467 - DNA, 23 bp, Homo sapiens
ggtaatgccactacaagcctgct

SEQ ID NO: 8468 - DNA, 25 bp, Homo sapiens
tgttgcagtagccttattgtatgga

SEQ ID NO: 8469 - DNA, 25 bp, Homo sapiens
gccttcttctctactccactgaacc

SEQ ID NO: 8470 - DNA, 25 bp, Homo sapiens
ccgacctgtgaaattctgggagaga

SEQ ID NO: 8471 - DNA, 25 bp, Homo sapiens
ggtgatttgctactaggacggtggg

SEQ ID NO: 8472 - DNA, 23 bp, Homo sapiens
gctgctgtctcggccttcttctc

SEQ ID NO: 8473 - DNA, 25 bp, Homo sapiens
tcatcacttcatatgtccgacctgt

SEQ ID NO: 8474 - DNA, 23 bp, Homo sapiens
actgaacccctttctgggaagtg

SEQ ID NO: 8475 - DNA, 24 bp, Homo sapiens
atggactctgtgttctgggacgga

SEQ ID NO: 8476 - DNA, 24 bp, Homo sapiens
ccgaagagcaaagcctgtggatgt

SEQ ID NO: 8477 - DNA, 24 bp, Homo sapiens
caccgactggcaggcatatctagg

SEQ ID NO: 8478 - DNA, 25 bp, Homo sapiens
acaacttcttactctgacagccacg

SEQ ID NO: 8479 - DNA, 23 bp, Homo sapiens
gaggtctttgggcagggcaacag

SEQ ID NO: 8480 - DNA, 23 bp, Homo sapiens
gcaaagcaagccctgagaaacat

SEQ ID NO: 8481 - DNA, 24 bp, Homo sapiens
tgataaaccaggtcaggacaatcg

SEQ ID NO: 8482 - DNA, 24 bp, Homo sapiens
ctgataaaccaggtcaggacaatc

SEQ ID NO: 8483 - DNA, 24 bp, Homo sapiens
gctgataaaccaggtcaggacaat

SEQ ID NO: 8484 - DNA, 24 bp, Homo sapiens
tcagtggcatcatcaagaggcagc

SEQ ID NO: 8485 - DNA, 24 bp, Homo sapiens
tcggtgggcagtaggaatcaagga

SEQ ID NO: 8486 - DNA, 23 bp, Homo sapiens
aggtcaggacaatcgcagcaagc

SEQ ID NO: 8487 - DNA, 25 bp, Homo sapiens
cctccaatctactcactgctgtcgg

SEQ ID NO: 8488 - DNA, 24 bp, Homo sapiens
cagatgccacgcttcgcctcataa

SEQ ID NO: 8489 - DNA, 23 bp, Homo sapiens
aggtcaggacaatcgcagcaagc

SEQ ID NO: 8490 - DNA, 25 bp, Homo sapiens
gcgagcacttcatctcagacttgtc

SEQ ID NO: 8491 - DNA, 23 bp, Homo sapiens
agcctctactgcctgtctgacga

SEQ ID NO: 8492 - DNA, 24 bp, Homo sapiens
cactccctctctgctctcctgtcc

SEQ ID NO: 8493 - DNA, 25 bp, Homo sapiens
cgacgacgctatgaagatgatggca

SEQ ID NO: 8494 - DNA, 25 bp, Homo sapiens
ggattcgttacagccagagattgcg

SEQ ID NO: 8495 - DNA, 25 bp, Homo sapiens
acagaagagtgagagatggaacccg

SEQ ID NO: 8496 - DNA, 25 bp, Homo sapiens
gctgtacgagaattggctgctgtca

SEQ ID NO: 8497 - DNA, 25 bp, Homo sapiens
agggagacatctttctgggtgaccg

SEQ ID NO: 8498 - DNA, 23 bp, Homo sapiens
agattgtcagcgcattgagctca

SEQ ID NO: 8499 - DNA, 24 bp, Homo sapiens
cagatgccacgcttcgcctcataa

SEQ ID NO: 8500 - DNA, 25 bp, Homo sapiens
cctccaatctactcactgctgtcgg

SEQ ID NO: 8501 - DNA, 25 bp, Homo sapiens
gcgagcacttcatctcagacttgtc

SEQ ID NO: 8502 - DNA, 24 bp, Homo sapiens
cagatgccacgcttcgcctcataa

SEQ ID NO: 8503 - DNA, 25 bp, Homo sapiens
gcagccaccttacagatcagtcctc

SEQ ID NO: 8504 - DNA, 24 bp, Homo sapiens
gtcgggtcttccactcgctactct

SEQ ID NO: 8505 - DNA, 24 bp, Homo sapiens
tattagtgaagggcgtcagcttct

SEQ ID NO: 8506 - DNA, 24 bp, Homo sapiens
atattagtgaagggcgtcagcttc

SEQ ID NO: 8507 - DNA, 24 bp, Homo sapiens
gatattagtgaagggcgtcagctt

SEQ ID NO: 8508 - DNA, 25 bp, Homo sapiens
gcagttcacaacacaagtctcacga

SEQ ID NO: 8509 - DNA, 25 bp, Homo sapiens
tgctccgccgaatacaatgacagaa

SEQ ID NO: 8510 - DNA, 25 bp, Homo sapiens
cggcacatgactcagaaggaacaag

SEQ ID NO: 8511 - DNA, 24 bp, Homo sapiens
ttgcctgacaagtgagtcttctct

SEQ ID NO: 8512 - DNA, 25 bp, Homo sapiens
ttcttggctgcttctcagacctaag

SEQ ID NO: 8513 - DNA, 25 bp, Homo sapiens
agagattcagtatgagaagttggca

SEQ ID NO: 8514 - DNA, 25 bp, Homo sapiens
aggacagcagtgattcagaagcaga

SEQ ID NO: 8515 - DNA, 23 bp, Homo sapiens
cctaaggacactccaagccaacc

SEQ ID NO: 8516 - DNA, 23 bp, Homo sapiens
ctgacagtggctctgacgactcc

SEQ ID NO: 8517 - DNA, 25 bp, Homo sapiens
ggtgaaggatgaaggtggtgacagc

SEQ ID NO: 8518 - DNA, 24 bp, Homo sapiens
ggaactgtggtcagctcttctgcc

SEQ ID NO: 8519 - DNA, 24 bp, Homo sapiens
cggtgcgtgtttgtcagaactgtt

SEQ ID NO: 8520 - DNA, 23 bp, Homo sapiens
atcttggctcaccgcaaactctg

SEQ ID NO: 8521 - DNA, 23 bp, Homo sapiens
tgaacgcccgactgcaagctgag

SEQ ID NO: 8522 - DNA, 23 bp, Homo sapiens
cctggagaggaggatttcagatc

SEQ ID NO: 8523 - DNA, 25 bp, Homo sapiens
gccgaaagaagagaggaacgaaggg

SEQ ID NO: 8524 - DNA, 23 bp, Homo sapiens
gattccaggcgggactatccagc

SEQ ID NO: 8525 - DNA, 25 bp, Homo sapiens
accaaggagactactatgaatcacg

SEQ ID NO: 8526 - DNA, 23 bp, Homo sapiens
ataccagctcctgagagactcgc

SEQ ID NO: 8527 - DNA, 23 bp, Homo sapiens
cttctcctcctccaagccaggct

SEQ ID NO: 8528 - DNA, 24 bp, Homo sapiens
tctatctggcaatgtacccggacc

SEQ ID NO: 8529 - DNA, 24 bp, Homo sapiens
gccaagaacaagcagcagtcctga

SEQ ID NO: 8530 - DNA, 23 bp, Homo sapiens
aagtcctcctccgcctcctcctc

SEQ ID NO: 8531 - DNA, 25 bp, Homo sapiens
ctgaaggatctggaggtaggaggct

SEQ ID NO: 8532 - DNA, 24 bp, Homo sapiens
gccaagaacaagcagcagtcctga

SEQ ID NO: 8533 - DNA, 23 bp, Homo sapiens
aagtcctcctccgcctcctcctc

SEQ ID NO: 8534 - DNA, 25 bp, Homo sapiens
cacacaacccagccctaatgatcgt

SEQ ID NO: 8535 - DNA, 24 bp, Homo sapiens
ggacactgagggtcgctatctctt

SEQ ID NO: 8536 - DNA, 24 bp, Homo sapiens
tggacactgagggtcgctatctct

SEQ ID NO: 8537 - DNA, 24 bp, Homo sapiens
ttggacactgagggtcgctatctc

SEQ ID NO: 8538 - DNA, 25 bp, Homo sapiens
ctggagtaatgccacctcagttcaa

SEQ ID NO: 8539 - DNA, 24 bp, Homo sapiens
agcaccatcactcactcagcacac

SEQ ID NO: 8540 - DNA, 23 bp, Homo sapiens
ggctgtggacttggacactgagg

SEQ ID NO: 8541 - DNA, 24 bp, Homo sapiens
acattctgcagatgctgggacgtg

SEQ ID NO: 8542 - DNA, 24 bp, Homo sapiens
gacattctgcagatgctgggacgt

SEQ ID NO: 8543 - DNA, 24 bp, Homo sapiens
ggacattctgcagatgctgggacg

SEQ ID NO: 8544 - DNA, 24 bp, Homo sapiens
gcgagaatgggcctgtcttagaag

SEQ ID NO: 8545 - DNA, 24 bp, Homo sapiens
ggcgagaatgggcctgtcttagaa

SEQ ID NO: 8546 - DNA, 24 bp, Homo sapiens
gggcgagaatgggcctgtcttaga

SEQ ID NO: 8547 - DNA, 23 bp, Homo sapiens
ggttgaccgaacactcgtggagg

SEQ ID NO: 8548 - DNA, 25 bp, Homo sapiens
acagtcatcatcaaaggcacccagg

SEQ ID NO: 8549 - DNA, 23 bp, Homo sapiens
gcgttggacagaactgggagcac

SEQ ID NO: 8550 - DNA, 25 bp, Homo sapiens
gccacctccaccttcaacttccatc

SEQ ID NO: 8551 - DNA, 23 bp, Homo sapiens
ccattcgcattgtggcactcagc

SEQ ID NO: 8552 - DNA, 23 bp, Homo sapiens
gctcccgaatgcgctacatctcc

SEQ ID NO: 8553 - DNA, 24 bp, Homo sapiens
ttaccacctgctggaggcggctga

SEQ ID NO: 8554 - DNA, 24 bp, Homo sapiens
ttccacagtacatcattgggcagc

SEQ ID NO: 8555 - DNA, 24 bp, Homo sapiens
cgcgggagggccaaggcattaaga

SEQ ID NO: 8556 - DNA, 24 bp, Homo sapiens
tatgagtttctggtgggctgcgtg

SEQ ID NO: 8557 - DNA, 24 bp, Homo sapiens
gaggtgatcttccgccagggctat

SEQ ID NO: 8558 - DNA, 24 bp, Homo sapiens
gagaaggacgcccgagagttcatc

SEQ ID NO: 8559 - DNA, 25 bp, Homo sapiens
acctacctcaacttgcgacacaact

SEQ ID NO: 8560 - DNA, 25 bp, Homo sapiens
cagcgaatcagtaccgtggatctct

SEQ ID NO: 8561 - DNA, 23 bp, Homo sapiens
ggcaacggcaagcatccaaggtg

SEQ ID NO: 8562 - DNA, 25 bp, Homo sapiens
acctacctcaacttgcgacacaact

SEQ ID NO: 8563 - DNA, 25 bp, Homo sapiens
ggaggttcctgagcatctcttctat

SEQ ID NO: 8564 - DNA, 25 bp, Homo sapiens
cagcgaatcagtaccgtggatctct

SEQ ID NO: 8565 - DNA, 25 bp, Homo sapiens
gaactgaacctaagtggcaacaagc

SEQ ID NO: 8566 - DNA, 25 bp, Homo sapiens
ccattcccacaaccatagcaaactg

SEQ ID NO: 8567 - DNA, 23 bp, Homo sapiens
gcacacccttgttgcacactcca

SEQ ID NO: 8568 - DNA, 24 bp, Homo sapiens
aaattaatcaagcagacaccaccc

SEQ ID NO: 8569 - DNA, 24 bp, Homo sapiens
gaaattaatcaagcagacaccacc

SEQ ID NO: 8570 - DNA, 24 bp, Homo sapiens
tgaaattaatcaagcagacaccac

SEQ ID NO: 8571 - DNA, 24 bp, Homo sapiens
gctcactcataactgcctcaactt

SEQ ID NO: 8572 - DNA, 24 bp, Homo sapiens
tcggcacttccactgatgagtcct

SEQ ID NO: 8573 - DNA, 25 bp, Homo sapiens
gccttcttagattcttcaaccttgc

SEQ ID NO: 8574 - DNA, 24 bp, Homo sapiens
tcggcacttccactgatgagtcct

SEQ ID NO: 8575 - DNA, 24 bp, Homo sapiens
gctcactcataactgcctcaactt

SEQ ID NO: 8576 - DNA, 25 bp, Homo sapiens
gcagacaccacccatcctttaacca

SEQ ID NO: 8577 - DNA, 25 bp, Homo sapiens
cctgaggtcatccgattgatagcca

SEQ ID NO: 8578 - DNA, 25 bp, Homo sapiens
tgcttggtacagatcgcttcagtca

SEQ ID NO: 8579 - DNA, 25 bp, Homo sapiens
gccttcttagattcttcaaccttgc

SEQ ID NO: 8580 - DNA, 25 bp, Homo sapiens
cgtgggtattaacattggctggagt

SEQ ID NO: 8581 - DNA, 24 bp, Homo sapiens
ttcatcattcaagggacaccgccg

SEQ ID NO: 8582 - DNA, 23 bp, Homo sapiens
aagattgagtctggaggtggcaa

SEQ ID NO: 8583 - DNA, 25 bp, Homo sapiens
gttccagcacctcatcttctccagc

SEQ ID NO: 8584 - DNA, 25 bp, Homo sapiens
tgcgtttgctgagagtagtatctgt

SEQ ID NO: 8585 - DNA, 25 bp, Homo sapiens
gctgttgcggtggaatcaatacaca

SEQ ID NO: 8586 - DNA, 24 bp, Homo sapiens
tcgatccccagatcccacatctgg

SEQ ID NO: 8587 - DNA, 24 bp, Homo sapiens
gtcgatccccagatcccacatctg

SEQ ID NO: 8588 - DNA, 24 bp, Homo sapiens
agtcgatccccagatcccacatct

SEQ ID NO: 8589 - DNA, 24 bp, Homo sapiens
ttctgtctctgccaccactgtcct

SEQ ID NO: 8590 - DNA, 25 bp, Homo sapiens
ggcattatcacaactccaagaacca

SEQ ID NO: 8591 - DNA, 25 bp, Homo sapiens
gactgtcccttgatgttatccttgc

SEQ ID NO: 8592 - DNA, 24 bp, Homo sapiens
atcaaggttatggatgtcacaggg

SEQ ID NO: 8593 - DNA, 24 bp, Homo sapiens
ccaccaggcatggatgaccaactt

SEQ ID NO: 8594 - DNA, 23 bp, Homo sapiens
gctggctctgtcaccgacctgat

SEQ ID NO: 8595 - DNA, 25 bp, Homo sapiens
ccttcagcattagtggagttcagcc

SEQ ID NO: 8596 - DNA, 25 bp, Homo sapiens
aggaggtagaagaacggtcaaggct

SEQ ID NO: 8597 - DNA, 25 bp, Homo sapiens
aatgagtcctagtgagaagccagca

SEQ ID NO: 8598 - DNA, 24 bp, Homo sapiens
tacttgggcaggtttaatgatatc

SEQ ID NO: 8599 - DNA, 24 bp, Homo sapiens
ctacttgggcaggtttaatgatat

SEQ ID NO: 8600 - DNA, 24 bp, Homo sapiens
gctacttgggcaggtttaatgata

SEQ ID NO: 8601 - DNA, 25 bp, Homo sapiens
cttgctgctgggagtgctattgtga

SEQ ID NO: 8602 - DNA, 24 bp, Homo sapiens
gtgatggagacttgacagaacagg

SEQ ID NO: 8603 - DNA, 25 bp, Homo sapiens
ttgctgctcctttgaaatctttggt

SEQ ID NO: 8604 - DNA, 25 bp, Homo sapiens
ggtctgaattggagaagcctagagg

SEQ ID NO: 8605 - DNA, 23 bp, Homo sapiens
gcccgtcacagaacaggaggaga

SEQ ID NO: 8606 - DNA, 24 bp, Homo sapiens
cagaatctgatgaacagcagtggc

SEQ ID NO: 8607 - DNA, 24 bp, Homo sapiens
atggatcaaagagatgccataaca

SEQ ID NO: 8608 - DNA, 24 bp, Homo sapiens
gatggatcaaagagatgccataac

SEQ ID NO: 8609 - DNA, 24 bp, Homo sapiens
agatggatcaaagagatgccataa

SEQ ID NO: 8610 - DNA, 23 bp, Homo sapiens
tctgcctcaccctctgctgttcc

SEQ ID NO: 8611 - DNA, 23 bp, Homo sapiens
aatccactgcttcaggagcctaa

SEQ ID NO: 8612 - DNA, 25 bp, Homo sapiens
cctctcccatcgcttcaacgagttc

SEQ ID NO: 8613 - DNA, 24 bp, Homo sapiens
ccccccatcagcctccccctcccc

SEQ ID NO: 8614 - DNA, 24 bp, Homo sapiens
tccccccatcagcctccccctccc

SEQ ID NO: 8615 - DNA, 24 bp, Homo sapiens
atccccccatcagcctccccctcc

SEQ ID NO: 8616 - DNA, 24 bp, Homo sapiens
acggcccccagtctcccaagcagc

SEQ ID NO: 8617 - DNA, 24 bp, Homo sapiens
aacggcccccagtctcccaagcag

SEQ ID NO: 8618 - DNA, 24 bp, Homo sapiens
caacggcccccagtctcccaagca

SEQ ID NO: 8619 - DNA, 25 bp, Homo sapiens
gaagaggacgatagggaaacccacg

SEQ ID NO: 8620 - DNA, 25 bp, Homo sapiens
actcagtctttctgttttcacaaag

SEQ ID NO: 8621 - DNA, 23 bp, Homo sapiens
ggaggaggagccgccgaggagac

SEQ ID NO: 8622 - DNA, 25 bp, Homo sapiens
tcaagtttgtgaaagaaaggacaga

SEQ ID NO: 8623 - DNA, 24 bp, Homo sapiens
gctctgggatcagtttgacaactt

SEQ ID NO: 8624 - DNA, 25 bp, Homo sapiens
ggacagagattgaactcagctatgc

SEQ ID NO: 8625 - DNA, 23 bp, Homo sapiens
ggaggaggagccgccgaggagac

SEQ ID NO: 8626 - DNA, 24 bp, Homo sapiens
gctctgggatcagtttgacaactt

SEQ ID NO: 8627 - DNA, 25 bp, Homo sapiens
agcaacctcccacctgaacaaagaa

SEQ ID NO: 8628 - DNA, 23 bp, Homo sapiens
aatccactgcttcaggagcctaa

SEQ ID NO: 8629 - DNA, 23 bp, Homo sapiens
tctgcctcaccctctgctgttcc

SEQ ID NO: 8630 - DNA, 24 bp, Homo sapiens
tactcacgctggtatgtgaattat

SEQ ID NO: 8631 - DNA, 24 bp, Homo sapiens
ttactcacgctggtatgtgaatta

SEQ ID NO: 8632 - DNA, 24 bp, Homo sapiens
tttactcacgctggtatgtgaatt

SEQ ID NO: 8633 - DNA, 24 bp, Homo sapiens
gctgaagggaggtaggttggaggg

SEQ ID NO: 8634 - DNA, 24 bp, Homo sapiens
ggctgaagggaggtaggttggagg

SEQ ID NO: 8635 - DNA, 24 bp, Homo sapiens
aggctgaagggaggtaggttggag

SEQ ID NO: 8636 - DNA, 24 bp, Homo sapiens
aacagaggactgtcttattccact

SEQ ID NO: 8637 - DNA, 24 bp, Homo sapiens
caacagaggactgtcttattccac

SEQ ID NO: 8638 - DNA, 24 bp, Homo sapiens
tcaacagaggactgtcttattcca

SEQ ID NO: 8639 - DNA, 24 bp, Homo sapiens
gagttacgcagtcttatgcaagat

SEQ ID NO: 8640 - DNA, 24 bp, Homo sapiens
agagttacgcagtcttatgcaaga

SEQ ID NO: 8641 - DNA, 24 bp, Homo sapiens
gagagttacgcagtcttatgcaag

SEQ ID NO: 8642 - DNA, 24 bp, Homo sapiens
ctgtaatgcaggtaagaatgaagg

SEQ ID NO: 8643 - DNA, 24 bp, Homo sapiens
tctgtaatgcaggtaagaatgaag

SEQ ID NO: 8644 - DNA, 24 bp, Homo sapiens
atctgtaatgcaggtaagaatgaa

SEQ ID NO: 8645 - DNA, 24 bp, Homo sapiens
catatgctgaggtgagtatataga

SEQ ID NO: 8646 - DNA, 24 bp, Homo sapiens
gcatatgctgaggtgagtatatag

SEQ ID NO: 8647 - DNA, 24 bp, Homo sapiens
agcatatgctgaggtgagtatata

SEQ ID NO: 8648 - DNA, 23 bp, Homo sapiens
atgctctgtcctcttccttgcca

SEQ ID NO: 8649 - DNA, 25 bp, Homo sapiens
agagatgtgtcgatgtttgccgtgt

SEQ ID NO: 8650 - DNA, 25 bp, Homo sapiens
aagcaccaagtaatacattccaccc

SEQ ID NO: 8651 - DNA, 24 bp, Homo sapiens
ggatggagcctggttcttggagga

SEQ ID NO: 8652 - DNA, 25 bp, Homo sapiens
tgagacagttcacttagccaatgga

SEQ ID NO: 8653 - DNA, 24 bp, Homo sapiens
cgtcacctgcttggttcagttact

SEQ ID NO: 8654 - DNA, 25 bp, Homo sapiens
gcatgtttgctcaagttgaaactgc

SEQ ID NO: 8655 - DNA, 24 bp, Homo sapiens
accgagaaatggttcagttgatga

SEQ ID NO: 8656 - DNA, 23 bp, Homo sapiens
tggccagatgcttttggtagcat

SEQ ID NO: 8657 - DNA, 24 bp, Homo sapiens
acccagcatagccccgtcgcagaa

SEQ ID NO: 8658 - DNA, 24 bp, Homo sapiens
tacccagcatagccccgtcgcaga

SEQ ID NO: 8659 - DNA, 24 bp, Homo sapiens
ctacccagcatagccccgtcgcag

SEQ ID NO: 8660 - DNA, 24 bp, Homo sapiens
ccagcatgcaggtggtcaaggagc

SEQ ID NO: 8661 - DNA, 24 bp, Homo sapiens
tccagcatgcaggtggtcaaggag

SEQ ID NO: 8662 - DNA, 24 bp, Homo sapiens
gtccagcatgcaggtggtcaagga

SEQ ID NO: 8663 - DNA, 23 bp, Homo sapiens
gcaggtggtcaaggagctggtcc

SEQ ID NO: 8664 - DNA, 25 bp, Homo sapiens
tggcaacatgaacaatcagcaggct

SEQ ID NO: 8665 - DNA, 25 bp, Homo sapiens
ttcctcaagtgaacctcagcaacat

SEQ ID NO: 8666 - DNA, 23 bp, Homo sapiens
cagtcagccacagtctcagcagc

SEQ ID NO: 8667 - DNA, 23 bp, Homo sapiens
cagcagcagccacagccacaact

SEQ ID NO: 8668 - DNA, 25 bp, Homo sapiens
ccacttcagcagatgcctcctcaac

SEQ ID NO: 8669 - DNA, 24 bp, Homo sapiens
gccaaatatgatgcagcccagcct

SEQ ID NO: 8670 - DNA, 23 bp, Homo sapiens
gcaggtggtcaaggagctggtcc

SEQ ID NO: 8671 - DNA, 23 bp, Homo sapiens
caggtgccttcgaccacagcaac

SEQ ID NO: 8672 - DNA, 25 bp, Homo sapiens
tggcaacatgaacaatcagcaggct

SEQ ID NO: 8673 - DNA, 25 bp, Homo sapiens
ttcctcaagtgaacctcagcaacat

SEQ ID NO: 8674 - DNA, 24 bp, Homo sapiens
gccagatggtccagcaacaaggaa

SEQ ID NO: 8675 - DNA, 25 bp, Homo sapiens
caccgttgcctggagaacaaggaat

SEQ ID NO: 8676 - DNA, 25 bp, Homo sapiens
ccacttcagcagatgcctcctcaac

SEQ ID NO: 8677 - DNA, 23 bp, Homo sapiens
cagcagcagccacagccacaact

SEQ ID NO: 8678 - DNA, 25 bp, Homo sapiens
cctctggctcaagtgtttgtccctt

SEQ ID NO: 8679 - DNA, 24 bp, Homo sapiens
ctaagtcctctccaggttggtcct

SEQ ID NO: 8680 - DNA, 23 bp, Homo sapiens
aagtgtccccaaggaagtgccac

SEQ ID NO: 8681 - DNA, 24 bp, Homo sapiens
ttcgagtgctgggcttaggtctgc

SEQ ID NO: 8682 - DNA, 24 bp, Homo sapiens
attcgagtgctgggcttaggtctg

SEQ ID NO: 8683 - DNA, 24 bp, Homo sapiens
tattcgagtgctgggcttaggtct

SEQ ID NO: 8684 - DNA, 24 bp, Homo sapiens
cctcaataaagcccttcagcatgc

SEQ ID NO: 8685 - DNA, 24 bp, Homo sapiens
acctcaataaagcccttcagcatg

SEQ ID NO: 8686 - DNA, 24 bp, Homo sapiens
gacctcaataaagcccttcagcat

SEQ ID NO: 8687 - DNA, 24 bp, Homo sapiens
gccccaaacggtcacccacaaaag

SEQ ID NO: 8688 - DNA, 24 bp, Homo sapiens
ggccccaaacggtcacccacaaaa

SEQ ID NO: 8689 - DNA, 24 bp, Homo sapiens
tggccccaaacggtcacccacaaa

SEQ ID NO: 8690 - DNA, 24 bp, Homo sapiens
agagtgtcacagtgaggctgtctt

SEQ ID NO: 8691 - DNA, 24 bp, Homo sapiens
cagagtgtcacagtgaggctgtct

SEQ ID NO: 8692 - DNA, 24 bp, Homo sapiens
tcagagtgtcacagtgaggctgtc

SEQ ID NO: 8693 - DNA, 23 bp, Homo sapiens
aggacttgcctggtgtgcctgaa

SEQ ID NO: 8694 - DNA, 25 bp, Homo sapiens
tcatccagattcagaagaactgcct

SEQ ID NO: 8695 - DNA, 25 bp, Homo sapiens
agtgaggctgtcttcaaaggaacca

SEQ ID NO: 8696 - DNA, 25 bp, Homo sapiens
caagagttcactgatgacattgagt

SEQ ID NO: 8697 - DNA, 25 bp, Homo sapiens
acgtgaagcacttcaacgatgttgt

SEQ ID NO: 8698 - DNA, 23 bp, Homo sapiens
aagtggcttaaagagcactcagc

SEQ ID NO: 8699 - DNA, 24 bp, Homo sapiens
cacgtcagtcatgcgtaatgggaa

SEQ ID NO: 8700 - DNA, 24 bp, Homo sapiens
gcacgtcagtcatgcgtaatggga

SEQ ID NO: 8701 - DNA, 24 bp, Homo sapiens
cgcacgtcagtcatgcgtaatggg

SEQ ID NO: 8702 - DNA, 24 bp, Homo sapiens
ccaatgaaatggtgagtgtgagtg

SEQ ID NO: 8703 - DNA, 24 bp, Homo sapiens
cccaatgaaatggtgagtgtgagt

SEQ ID NO: 8704 - DNA, 24 bp, Homo sapiens
tcccaatgaaatggtgagtgtgag

SEQ ID NO: 8705 - DNA, 24 bp, Homo sapiens
agctctgtaaggaccaagttagaa

SEQ ID NO: 8706 - DNA, 24 bp, Homo sapiens
cagctctgtaaggaccaagttaga

SEQ ID NO: 8707 - DNA, 24 bp, Homo sapiens
acagctctgtaaggaccaagttag

SEQ ID NO: 8708 - DNA, 24 bp, Homo sapiens
agaccaaaaaggattctggatgga

SEQ ID NO: 8709 - DNA, 24 bp, Homo sapiens
aagaccaaaaaggattctggatgg

SEQ ID NO: 8710 - DNA, 24 bp, Homo sapiens
aaagaccaaaaaggattctggatg

SEQ ID NO: 8711 - DNA, 25 bp, Homo sapiens
atggtgattctggatcgccttggat

SEQ ID NO: 8712 - DNA, 24 bp, Homo sapiens
gcatttcaaaccattatcaacaac

SEQ ID NO: 8713 - DNA, 23 bp, Homo sapiens
tctggggtcaacttatggatcct

SEQ ID NO: 8714 - DNA, 25 bp, Homo sapiens
gctcctgagagaataaatgaagaga

SEQ ID NO: 8715 - DNA, 25 bp, Homo sapiens
tggctaaacagctttatccaaagga

SEQ ID NO: 8716 - DNA, 25 bp, Homo sapiens
acgaatatcattctggttatgttca

SEQ ID NO: 8717 - DNA, 24 bp, Homo sapiens
gctggtatcaggcatcatcttctc

SEQ ID NO: 8718 - DNA, 24 bp, Homo sapiens
tgctggtatcaggcatcatcttct

SEQ ID NO: 8719 - DNA, 24 bp, Homo sapiens
gtgctggtatcaggcatcatcttc

SEQ ID NO: 8720 - DNA, 24 bp, Homo sapiens
gctgtcaagtggggctcacctgga

SEQ ID NO: 8721 - DNA, 24 bp, Homo sapiens
ggctgtcaagtggggctcacctgg

SEQ ID NO: 8722 - DNA, 24 bp, Homo sapiens
tggctgtcaagtggggctcacctg

SEQ ID NO: 8723 - DNA, 24 bp, Homo sapiens
tgtggctccggctcctcctctgtc

SEQ ID NO: 8724 - DNA, 24 bp, Homo sapiens
ctcctatggacagggcaccccgct

SEQ ID NO: 8725 - DNA, 24 bp, Homo sapiens
aatagcggtgggacacccttctcc

SEQ ID NO: 8726 - DNA, 24 bp, Homo sapiens
ggacacccttctcccaggacacag

SEQ ID NO: 8727 - DNA, 24 bp, Homo sapiens
cctcatacctcttcagccaggacc

SEQ ID NO: 8728 - DNA, 24 bp, Homo sapiens
gagagcaagttcacggacgcctac

SEQ ID NO: 8729 - DNA, 24 bp, Homo sapiens
ctgtctcagtggaatgttttgagt

SEQ ID NO: 8730 - DNA, 24 bp, Homo sapiens
actgtctcagtggaatgttttgag

SEQ ID NO: 8731 - DNA, 24 bp, Homo sapiens
aactgtctcagtggaatgttttga

SEQ ID NO: 8732 - DNA, 24 bp, Homo sapiens
atggccctgaggtgctggagtctc

SEQ ID NO: 8733 - DNA, 24 bp, Homo sapiens
aatggccctgaggtgctggagtct

SEQ ID NO: 8734 - DNA, 24 bp, Homo sapiens
aaatggccctgaggtgctggagtc

SEQ ID NO: 8735 - DNA, 24 bp, Homo sapiens
ctatgagtcaggaattatgcatag

SEQ ID NO: 8736 - DNA, 24 bp, Homo sapiens
gctatgagtcaggaattatgcata

SEQ ID NO: 8737 - DNA, 24 bp, Homo sapiens
agctatgagtcaggaattatgcat

SEQ ID NO: 8738 - DNA, 25 bp, Homo sapiens
accgagcattctgtgttaccatcct

SEQ ID NO: 8739 - DNA, 25 bp, Homo sapiens
ccattccaatctcagttgcccagtg

SEQ ID NO: 8740 - DNA, 25 bp, Homo sapiens
tcttcctgtgaaaatgccttgtctc

SEQ ID NO: 8741 - DNA, 24 bp, Homo sapiens
aagctcaccaggtgattaaagcca

SEQ ID NO: 8742 - DNA, 24 bp, Homo sapiens
gaagctcaccaggtgattaaagcc

SEQ ID NO: 8743 - DNA, 24 bp, Homo sapiens
ggaagctcaccaggtgattaaagc

SEQ ID NO: 8744 - DNA, 23 bp, Homo sapiens
cctttccttccagcagcctcagc

SEQ ID NO: 8745 - DNA, 23 bp, Homo sapiens
gcctgcctctgctctctcatctc

SEQ ID NO: 8746 - DNA, 25 bp, Homo sapiens
cctccctcttccctagtacacagcc

SEQ ID NO: 8747 - DNA, 25 bp, Homo sapiens
agccctgaaacactggagcaagatg

SEQ ID NO: 8748 - DNA, 25 bp, Homo sapiens
tgaataaccacagcatgacagccat

SEQ ID NO: 8749 - DNA, 23 bp, Homo sapiens
agtgtggacgagatactggtgcc

SEQ ID NO: 8750 - DNA, 25 bp, Homo sapiens
aatgaagaatggagaggtgtggaca

SEQ ID NO: 8751 - DNA, 25 bp, Homo sapiens
tcaactaagagcagacggcaatcca

SEQ ID NO: 8752 - DNA, 25 bp, Homo sapiens
acgggacaagcacaaagatggaagt

SEQ ID NO: 8753 - DNA, 24 bp, Homo sapiens
aggctctgtgcgatttgactgtga

SEQ ID NO: 8754 - DNA, 25 bp, Homo sapiens
ccactcttgttcaagcattgccagg

SEQ ID NO: 8755 - DNA, 23 bp, Homo sapiens
caggcagcaaccatacggcagta

SEQ ID NO: 8756 - DNA, 25 bp, Homo sapiens
tggatggacaggtcttcacatttgg

SEQ ID NO: 8757 - DNA, 24 bp, Homo sapiens
ttctaaaggacaactgggcagacc

SEQ ID NO: 8758 - DNA, 23 bp, Homo sapiens
tcaagcattgccaggccctagca

SEQ ID NO: 8759 - DNA, 24 bp, Homo sapiens
cttttaatggatggacaggtcttc

SEQ ID NO: 8760 - DNA, 23 bp, Homo sapiens
tcactgcaggcagcaaccatacg

SEQ ID NO: 8761 - DNA, 25 bp, Homo sapiens
gctggaccaccttagtcttaggagt

SEQ ID NO: 8762 - DNA, 25 bp, Homo sapiens
tgttgtctgaggttattgcgtgtct

SEQ ID NO: 8763 - DNA, 25 bp, Homo sapiens
tgcctgctttcattctttctaccca

SEQ ID NO: 8764 - DNA, 25 bp, Homo sapiens
tgcctgctttcattctttctaccca

SEQ ID NO: 8765 - DNA, 24 bp, Homo sapiens
gggcttgcctttgtgatctgctga

SEQ ID NO: 8766 - DNA, 25 bp, Homo sapiens
tcaagacatcaagtagccgactcct

SEQ ID NO: 8767 - DNA, 25 bp, Homo sapiens
tcaagacatcaagtagccgactcct

SEQ ID NO: 8768 - DNA, 25 bp, Homo sapiens
ccgattgcgtatgatggagaagtat

SEQ ID NO: 8769 - DNA, 25 bp, Homo sapiens
tgttatgtcagctctgtgtcacacg

SEQ ID NO: 8770 - DNA, 25 bp, Homo sapiens
tgaatttagccctggacctgatgag

SEQ ID NO: 8771 - DNA, 25 bp, Homo sapiens
ctctgatgaagaaggacctagcact

SEQ ID NO: 8772 - DNA, 25 bp, Homo sapiens
accactccaaatccaaagcaatgaa

SEQ ID NO: 8773 - DNA, 25 bp, Homo sapiens
ttctcaaactcctcctccaagccct

SEQ ID NO: 8774 - DNA, 25 bp, Homo sapiens
gaggtcagattcccacagtaggtca

SEQ ID NO: 8775 - DNA, 25 bp, Homo sapiens
ttctcggttgtcatctcctaagcca

SEQ ID NO: 8776 - DNA, 25 bp, Homo sapiens
accgagcattctgtgttaccatcct

SEQ ID NO: 8777 - DNA, 25 bp, Homo sapiens
ccattccaatctcagttgcccagtg

SEQ ID NO: 8778 - DNA, 25 bp, Homo sapiens
tctacgttcaacatctgtacctgcc

SEQ ID NO: 8779 - DNA, 25 bp, Homo sapiens
accgagcattctgtgttaccatcct

SEQ ID NO: 8780 - DNA, 25 bp, Homo sapiens
ccattccaatctcagttgcccagtg

SEQ ID NO: 8781 - DNA, 23 bp, Homo sapiens
cactcttcctgctgtccctgagc

SEQ ID NO: 8782 - DNA, 25 bp, Homo sapiens
tctacgttcaacatctgtacctgcc

SEQ ID NO: 8783 - DNA, 25 bp, Homo sapiens
gccaccaagtttagaaaccagtccc

SEQ ID NO: 8784 - DNA, 25 bp, Homo sapiens
atcatactcagttgttgcttccgaa

SEQ ID NO: 8785 - DNA, 24 bp, Homo sapiens
gtggagacactgaagttggttctt

SEQ ID NO: 8786 - DNA, 25 bp, Homo sapiens
atcatactcagttgttgcttccgaa

SEQ ID NO: 8787 - DNA, 25 bp, Homo sapiens
gccaccaagtttagaaaccagtccc

SEQ ID NO: 8788 - DNA, 25 bp, Homo sapiens
caccagttccttcatcagagcaacg

SEQ ID NO: 8789 - DNA, 25 bp, Homo sapiens
aacttcaagccgacctgccatgatt

SEQ ID NO: 8790 - DNA, 25 bp, Homo sapiens
gacagacggctccacagaaaccttt

SEQ ID NO: 8791 - DNA, 23 bp, Homo sapiens
gctgcgatgctgaggctggacgg

SEQ ID NO: 8792 - DNA, 25 bp, Homo sapiens
atgtttccagggctcagatgtgtcc

SEQ ID NO: 8793 - DNA, 24 bp, Homo sapiens
gcaggtcccaaaggcaagcagtta

SEQ ID NO: 8794 - DNA, 23 bp, Homo sapiens
gctgcgatgctgaggctggacgg

SEQ ID NO: 8795 - DNA, 23 bp, Homo sapiens
agctcatttgtggtgcctgttct

SEQ ID NO: 8796 - DNA, 24 bp, Homo sapiens
gcaggtcccaaaggcaagcagtta

SEQ ID NO: 8797 - DNA, 25 bp, Homo sapiens
gtccactccatgttgttcatccacc

SEQ ID NO: 8798 - DNA, 24 bp, Homo sapiens
tttgctctgggatgtggagtgtgc

SEQ ID NO: 8799 - DNA, 25 bp, Homo sapiens
ttggagcagaagaaggaggagtgtc

SEQ ID NO: 8800 - DNA, 23 bp, Homo sapiens
gcttcttctctggcatcctcagg

SEQ ID NO: 8801 - DNA, 25 bp, Homo sapiens
aggactcacggcttaagacactaga

SEQ ID NO: 8802 - DNA, 24 bp, Homo sapiens
gacctgatcacccgcgccatcgag

SEQ ID NO: 8803 - DNA, 24 bp, Homo sapiens
ggacctgatcacccgcgccatcga

SEQ ID NO: 8804 - DNA, 24 bp, Homo sapiens
cggacctgatcacccgcgccatcg

SEQ ID NO: 8805 - DNA, 24 bp, Homo sapiens
acctgaaaagggaagtcgaggctc

SEQ ID NO: 8806 - DNA, 24 bp, Homo sapiens
tacctgaaaagggaagtcgaggct

SEQ ID NO: 8807 - DNA, 24 bp, Homo sapiens
ttacctgaaaagggaagtcgaggc

SEQ ID NO: 8808 - DNA, 24 bp, Homo sapiens
gacaagccaaggtctacttcccca

SEQ ID NO: 8809 - DNA, 24 bp, Homo sapiens
agacaagccaaggtctacttcccc

SEQ ID NO: 8810 - DNA, 24 bp, Homo sapiens
gagacaagccaaggtctacttccc

SEQ ID NO: 8811 - DNA, 24 bp, Homo sapiens
acagaggtgacagaagcagagcat

SEQ ID NO: 8812 - DNA, 25 bp, Homo sapiens
agtgactggtctgatgaggatgtcc

SEQ ID NO: 8813 - DNA, 25 bp, Homo sapiens
tgatgaagaagcagcccagcaaagt

SEQ ID NO: 8814 - DNA, 25 bp, Homo sapiens
agagaagacatggagagcgagaccg

SEQ ID NO: 8815 - DNA, 25 bp, Homo sapiens
aagagacaacagagatcaagcaagg

SEQ ID NO: 8816 - DNA, 24 bp, Homo sapiens
ggaagtcgaggctcaagaggttct

SEQ ID NO: 8817 - DNA, 25 bp, Homo sapiens
gagatggaaaggacagaggacgaga

SEQ ID NO: 8818 - DNA, 25 bp, Homo sapiens
ccctgttggaccagcagagaaattc

SEQ ID NO: 8819 - DNA, 25 bp, Homo sapiens
agtctagcaaatctccgaagcgaaa

SEQ ID NO: 8820 - DNA, 25 bp, Homo sapiens
cccagaaacgaaatacagaggagtc

SEQ ID NO: 8821 - DNA, 25 bp, Homo sapiens
aatgaagcgtcagaagatacagagg

SEQ ID NO: 8822 - DNA, 25 bp, Homo sapiens
aaagtctagcaaatctccgaagcga

SEQ ID NO: 8823 - DNA, 25 bp, Homo sapiens
aatgaagcgtcagaagatacagagg

SEQ ID NO: 8824 - DNA, 25 bp, Homo sapiens
aaagtctagcaaatctccgaagcga

SEQ ID NO: 8825 - DNA, 25 bp, Homo sapiens
ccctgttggaccagcagagaaattc

SEQ ID NO: 8826 - DNA, 25 bp, Homo sapiens
gagatggaaaggacagaggacgaga

SEQ ID NO: 8827 - DNA, 23 bp, Homo sapiens
ccagcaggacagcatcattctcc

SEQ ID NO: 8828 - DNA, 25 bp, Homo sapiens
acatcactcatcttcctcacaatca

SEQ ID NO: 8829 - DNA, 25 bp, Homo sapiens
aatgaagcgtcagaagatacagagg

SEQ ID NO: 8830 - DNA, 25 bp, Homo sapiens
cccagaaacgaaatacagaggagtc

SEQ ID NO: 8831 - DNA, 25 bp, Homo sapiens
gcagcaattatagaaggtcaccaga

SEQ ID NO: 8832 - DNA, 25 bp, Homo sapiens
gagatggaaaggacagaggacgaga

SEQ ID NO: 8833 - DNA, 25 bp, Homo sapiens
ccctgttggaccagcagagaaattc

SEQ ID NO: 8834 - DNA, 25 bp, Homo sapiens
aaagtctagcaaatctccgaagcga

SEQ ID NO: 8835 - DNA, 23 bp, Homo sapiens
tcttcttcctcctccaccgcctg

SEQ ID NO: 8836 - DNA, 24 bp, Homo sapiens
aactcttgctgccactactgctgc

SEQ ID NO: 8837 - DNA, 24 bp, Homo sapiens
acagaggtgacagaagcagagcat

SEQ ID NO: 8838 - DNA, 24 bp, Homo sapiens
gccgggaacctgtctacaactcga

SEQ ID NO: 8839 - DNA, 24 bp, Homo sapiens
ggccgggaacctgtctacaactcg

SEQ ID NO: 8840 - DNA, 24 bp, Homo sapiens
tggccgggaacctgtctacaactc

SEQ ID NO: 8841 - DNA, 24 bp, Homo sapiens
ggatacggatgattgagaatgcca

SEQ ID NO: 8842 - DNA, 24 bp, Homo sapiens
cggatacggatgattgagaatgcc

SEQ ID NO: 8843 - DNA, 24 bp, Homo sapiens
acggatacggatgattgagaatgc

SEQ ID NO: 8844 - DNA, 24 bp, Homo sapiens
gggctgccaaggaagccaaaaaga

SEQ ID NO: 8845 - DNA, 24 bp, Homo sapiens
ggggctgccaaggaagccaaaaag

SEQ ID NO: 8846 - DNA, 24 bp, Homo sapiens
cggggctgccaaggaagccaaaaa

SEQ ID NO: 8847 - DNA, 23 bp, Homo sapiens
tccagccctatgcccacctcatc

SEQ ID NO: 8848 - DNA, 25 bp, Homo sapiens
cagcatccttaattccagcagcagc

SEQ ID NO: 8849 - DNA, 24 bp, Homo sapiens
cgctcttccacaccgttcagtcaa

SEQ ID NO: 8850 - DNA, 25 bp, Homo sapiens
cagcatccttaattccagcagcagc

SEQ ID NO: 8851 - DNA, 25 bp, Homo sapiens
aaggaacagcatcatcaactccagt

SEQ ID NO: 8852 - DNA, 24 bp, Homo sapiens
cgctcttccacaccgttcagtcaa

SEQ ID NO: 8853 - DNA, 25 bp, Homo sapiens
cagcatccttaattccagcagcagc

SEQ ID NO: 8854 - DNA, 24 bp, Homo sapiens
cgctcttccacaccgttcagtcaa

SEQ ID NO: 8855 - DNA, 25 bp, Homo sapiens
acctgtctcggaagaagagcagtga

SEQ ID NO: 8856 - DNA, 25 bp, Homo sapiens
accctaaaggaaatgccaatcgtga

SEQ ID NO: 8857 - DNA, 25 bp, Homo sapiens
tgaggaggtcataagtcaagaggat

SEQ ID NO: 8858 - DNA, 25 bp, Homo sapiens
ggtattccatgccgacgctattctt

SEQ ID NO: 8859 - DNA, 23 bp, Homo sapiens
caggcacagtcggcaggagattg

SEQ ID NO: 8860 - DNA, 25 bp, Homo sapiens
ggcagcactgatgtagatgacctca

SEQ ID NO: 8861 - DNA, 25 bp, Homo sapiens
tctgacaagaggtcgtgtgaagaga

SEQ ID NO: 8862 - DNA, 23 bp, Homo sapiens
aggctgaggcaggagaatggcat

SEQ ID NO: 8863 - DNA, 25 bp, Homo sapiens
ggcaacagagcaatactccatctca

SEQ ID NO: 8864 - DNA, 23 bp, Homo sapiens
gtgagccacgattgtgccactgc

SEQ ID NO: 8865 - DNA, 25 bp, Homo sapiens
aagggtaatttgcgtgtgcgtgaac

SEQ ID NO: 8866 - DNA, 25 bp, Homo sapiens
ggaggatctgtccaagttggcagtt

SEQ ID NO: 8867 - DNA, 25 bp, Homo sapiens
acattgctgacctcatggatgctgg

SEQ ID NO: 8868 - DNA, 24 bp, Homo sapiens
gcagtggctatgattcaggagaca

SEQ ID NO: 8869 - DNA, 25 bp, Homo sapiens
ctcagcacctccaccagtatctcct

SEQ ID NO: 8870 - DNA, 25 bp, Homo sapiens
cgtgagagacttggtgacagcatcc

SEQ ID NO: 8871 - DNA, 24 bp, Homo sapiens
tttccccccaggtttctgcctcaa

SEQ ID NO: 8872 - DNA, 24 bp, Homo sapiens
atttccccccaggtttctgcctca

SEQ ID NO: 8873 - DNA, 24 bp, Homo sapiens
atttccccccaggtttctgcctca

SEQ ID NO: 8874 - DNA, 23 bp, Homo sapiens
cagcagcagcaacagcagcagtt

SEQ ID NO: 8875 - DNA, 25 bp, Homo sapiens
cccaggtttctgcctcaatgctcaa

SEQ ID NO: 8876 - DNA, 25 bp, Homo sapiens
gcagccactaaattcttctcccagt

SEQ ID NO: 8877 - DNA, 24 bp, Homo sapiens
gctcgcctcggcctctacctggag

SEQ ID NO: 8878 - DNA, 24 bp, Homo sapiens
ggctcgcctcggcctctacctgga

SEQ ID NO: 8879 - DNA, 24 bp, Homo sapiens
cggctcgcctcggcctctacctgg

SEQ ID NO: 8880 - DNA, 23 bp, Homo sapiens
accatccttgctgagtttgccac

SEQ ID NO: 8881 - DNA, 24 bp, Homo sapiens
ccgtgggacctgctctgaatcttt

SEQ ID NO: 8882 - DNA, 25 bp, Homo sapiens
cttctgggaggagggtcggattcaa

SEQ ID NO: 8883 - DNA, 24 bp, Homo sapiens
gcagcggagcatcgtcattcttca

SEQ ID NO: 8884 - DNA, 24 bp, Homo sapiens
gctcactacaacctccgcatcctg

SEQ ID NO: 8885 - DNA, 24 bp, Homo sapiens
aggaaggttgatggacggatggct

SEQ ID NO: 8886 - DNA, 24 bp, Homo sapiens
gcgcaagccacggcactcagctaa

SEQ ID NO: 8887 - DNA, 24 bp, Homo sapiens
ggcgcaagccacggcactcagcta

SEQ ID NO: 8888 - DNA, 24 bp, Homo sapiens
aggcgcaagccacggcactcagct

SEQ ID NO: 8889 - DNA, 24 bp, Homo sapiens
tcaagacacctgccgagcgtctgc

SEQ ID NO: 8890 - DNA, 24 bp, Homo sapiens
atcaagacacctgccgagcgtctg

SEQ ID NO: 8891 - DNA, 24 bp, Homo sapiens
catcaagacacctgccgagcgtct

SEQ ID NO: 8892 - DNA, 24 bp, Homo sapiens
tccaccctcagccgatgataatct

SEQ ID NO: 8893 - DNA, 24 bp, Homo sapiens
ttccaccctcagccgatgataatc

SEQ ID NO: 8894 - DNA, 24 bp, Homo sapiens
cttccaccctcagccgatgataat

SEQ ID NO: 8895 - DNA, 24 bp, Homo sapiens
tccaccatcagcggatgataatct

SEQ ID NO: 8896 - DNA, 24 bp, Homo sapiens
ttccaccatcagcggatgataatc

SEQ ID NO: 8897 - DNA, 24 bp, Homo sapiens
cttccaccatcagcggatgataat

SEQ ID NO: 8898 - DNA, 24 bp, Homo sapiens
acctgaggaaggtgagtgagtgca

SEQ ID NO: 8899 - DNA, 24 bp, Homo sapiens
tacctgaggaaggtgagtgagtgc

SEQ ID NO: 8900 - DNA, 24 bp, Homo sapiens
gtacctgaggaaggtgagtgagtg

SEQ ID NO: 8901 - DNA, 24 bp, Homo sapiens
gccagaaaacagaaaatgtttcaa

SEQ ID NO: 8902 - DNA, 24 bp, Homo sapiens
cgccagaaaacagaaaatgtttca

SEQ ID NO: 8903 - DNA, 24 bp, Homo sapiens
ccgccagaaaacagaaaatgtttc

SEQ ID NO: 8904 - DNA, 24 bp, Homo sapiens
gtaatccataggaaaatgtttcaa

SEQ ID NO: 8905 - DNA, 24 bp, Homo sapiens
tgtaatccataggaaaatgtttca

SEQ ID NO: 8906 - DNA, 24 bp, Homo sapiens
ttgtaatccataggaaaatgtttc

SEQ ID NO: 8907 - DNA, 24 bp, Homo sapiens
acaaatgcaaaatccccccttctg

SEQ ID NO: 8908 - DNA, 24 bp, Homo sapiens
cacaaatgcaaaatccccccttct

SEQ ID NO: 8909 - DNA, 24 bp, Homo sapiens
ccacaaatgcaaaatccccccttc

SEQ ID NO: 8910 - DNA, 24 bp, Homo sapiens
acaaatgcaaagtaaggagcttcc

SEQ ID NO: 8911 - DNA, 24 bp, Homo sapiens
cacaaatgcaaagtaaggagcttc

SEQ ID NO: 8912 - DNA, 24 bp, Homo sapiens
ccacaaatgcaaagtaaggagctt

SEQ ID NO: 8913 - DNA, 24 bp, Homo sapiens
tttgcaactgggtcagaatggcgg

SEQ ID NO: 8914 - DNA, 24 bp, Homo sapiens
ctttgcaactgggtcagaatggcg

SEQ ID NO: 8915 - DNA, 24 bp, Homo sapiens
tctttgcaactgggtcagaatggc

SEQ ID NO: 8916 - DNA, 24 bp, Homo sapiens
tatcttggcagtcgagttgaactg

SEQ ID NO: 8917 - DNA, 24 bp, Homo sapiens
ttatcttggcagtcgagttgaact

SEQ ID NO: 8918 - DNA, 24 bp, Homo sapiens
attatcttggcagtcgagttgaac

SEQ ID NO: 8919 - DNA, 24 bp, Homo sapiens
tcactacgcagggatttcctgtaa

SEQ ID NO: 8920 - DNA, 24 bp, Homo sapiens
atcactacgcagggatttcctgta

SEQ ID NO: 8921 - DNA, 24 bp, Homo sapiens
tatcactacgcagggatttcctgt

SEQ ID NO: 8922 - DNA, 24 bp, Homo sapiens
actagttccagccccaggtaccca

SEQ ID NO: 8923 - DNA, 24 bp, Homo sapiens
cactagttccagccccaggtaccc

SEQ ID NO: 8924 - DNA, 24 bp, Homo sapiens
acactagttccagccccaggtacc

SEQ ID NO: 8925 - DNA, 23 bp, Homo sapiens
atccaccaccgttagtagcagcg

SEQ ID NO: 8926 - DNA, 25 bp, Homo sapiens
acagcgacagtacaaagaagactct

SEQ ID NO: 8927 - DNA, 23 bp, Homo sapiens
catgcttctgttgctgggcacct

SEQ ID NO: 8928 - DNA, 25 bp, Homo sapiens
aggtctgggcacaatggttactcaa

SEQ ID NO: 8929 - DNA, 25 bp, Homo sapiens
ttgttaagccgacagttggagttcc

SEQ ID NO: 8930 - DNA, 23 bp, Homo sapiens
ccaccaccaacaccttcaccacc

SEQ ID NO: 8931 - DNA, 23 bp, Homo sapiens
ctgccacacagccaacctcactg

SEQ ID NO: 8932 - DNA, 23 bp, Homo sapiens
gtccactcccagcacttctacca

SEQ ID NO: 8933 - DNA, 23 bp, Homo sapiens
gaagcaccgtcccacagtcccag

SEQ ID NO: 8934 - DNA, 25 bp, Homo sapiens
ctttgttacctctgtgggcgatgct

SEQ ID NO: 8935 - DNA, 25 bp, Homo sapiens
gtattcaacccctctcacagatcca

SEQ ID NO: 8936 - DNA, 23 bp, Homo sapiens
tggaatcaagctggcctgcactt

SEQ ID NO: 8937 - DNA, 25 bp, Homo sapiens
aggtctgggcacaatggttactcaa

SEQ ID NO: 8938 - DNA, 24 bp, Homo sapiens
acagccactcatcctgacccagaa

SEQ ID NO: 8939 - DNA, 23 bp, Homo sapiens
gcctgttcaggtcatgcagaatg

SEQ ID NO: 8940 - DNA, 23 bp, Homo sapiens
ccaccaccaacaccttcaccacc

SEQ ID NO: 8941 - DNA, 25 bp, Homo sapiens
gcaactagctgttcagtctccaggc

SEQ ID NO: 8942 - DNA, 24 bp, Homo sapiens
actgtgaagcgacctggtgttaca

SEQ ID NO: 8943 - DNA, 25 bp, Homo sapiens
ttgttaagccgacagttggagttcc

SEQ ID NO: 8944 - DNA, 23 bp, Homo sapiens
ccaccaccaacaccttcaccacc

SEQ ID NO: 8945 - DNA, 24 bp, Homo sapiens
ttctaccactcccactgccacaca

SEQ ID NO: 8946 - DNA, 25 bp, Homo sapiens
ggttgggattgtgctgaacgtacag

SEQ ID NO: 8947 - DNA, 23 bp, Homo sapiens
gtccggcctgtacaaaatgcaat

SEQ ID NO: 8948 - DNA, 23 bp, Homo sapiens
ccaccaccaacaccttcaccacc

SEQ ID NO: 8949 - DNA, 25 bp, Homo sapiens
gcaactagctgttcagtctccaggc

SEQ ID NO: 8950 - DNA, 25 bp, Homo sapiens
aagccgacagttggagttccacaag

SEQ ID NO: 8951 - DNA, 24 bp, Homo sapiens
ttctaccactcccactgccacaca

SEQ ID NO: 8952 - DNA, 23 bp, Homo sapiens
gaagcaccgtcccacagtcccag

SEQ ID NO: 8953 - DNA, 23 bp, Homo sapiens
ccaccaccaacaccttcaccacc

SEQ ID NO: 8954 - DNA, 24 bp, Homo sapiens
cctccctgcagccccgagatgggg

SEQ ID NO: 8955 - DNA, 24 bp, Homo sapiens
gcctccctgcagccccgagatggg

SEQ ID NO: 8956 - DNA, 24 bp, Homo sapiens
ggcctccctgcagccccgagatgg

SEQ ID NO: 8957 - DNA, 24 bp, Homo sapiens
ctccgctgaggctcgccccgagac

SEQ ID NO: 8958 - DNA, 24 bp, Homo sapiens
cctccgctgaggctcgccccgaga

SEQ ID NO: 8959 - DNA, 24 bp, Homo sapiens
acctccgctgaggctcgccccgag

SEQ ID NO: 8960 - DNA, 24 bp, Homo sapiens
ccctcccctagctcgccccgagac

SEQ ID NO: 8961 - DNA, 24 bp, Homo sapiens
cccctcccctagctcgccccgaga

SEQ ID NO: 8962 - DNA, 24 bp, Homo sapiens
tcccctcccctagctcgccccgag

SEQ ID NO: 8963 - DNA, 24 bp, Homo sapiens
cctgactcgctgctgaagatgacc

SEQ ID NO: 8964 - DNA, 23 bp, Homo sapiens
ccacctgacctcgccacgcactt

SEQ ID NO: 8965 - DNA, 23 bp, Homo sapiens
tggaggtgctggagtgtctgtgg

SEQ ID NO: 8966 - DNA, 23 bp, Homo sapiens
cgcccatctgcgccacacacaga

SEQ ID NO: 8967 - DNA, 23 bp, Homo sapiens
ctgggctcccaggcctcagctcg

SEQ ID NO: 8968 - DNA, 24 bp, Homo sapiens
gctgccctcaccgaggccccagct

SEQ ID NO: 8969 - DNA, 24 bp, Homo sapiens
tgctgccctcaccgaggccccagc

SEQ ID NO: 8970 - DNA, 24 bp, Homo sapiens
atgctgccctcaccgaggccccag

SEQ ID NO: 8971 - DNA, 25 bp, Homo sapiens
gttgaagagaagagacgcccatccg

SEQ ID NO: 8972 - DNA, 24 bp, Homo sapiens
agcagaccatccatccgatcctcc

SEQ ID NO: 8973 - DNA, 25 bp, Homo sapiens
cctgtccttccttcgtggattgtct

SEQ ID NO: 8974 - DNA, 24 bp, Homo sapiens
cgcgccagcaggaatgccaaggtg

SEQ ID NO: 8975 - DNA, 24 bp, Homo sapiens
gcgcgccagcaggaatgccaaggt

SEQ ID NO: 8976 - DNA, 24 bp, Homo sapiens
tgcgcgccagcaggaatgccaagg

SEQ ID NO: 8977 - DNA, 24 bp, Homo sapiens
ccgaacgccaggccaccaggagaa

SEQ ID NO: 8978 - DNA, 24 bp, Homo sapiens
gccgaacgccaggccaccaggaga

SEQ ID NO: 8979 - DNA, 24 bp, Homo sapiens
agccgaacgccaggccaccaggag

SEQ ID NO: 8980 - DNA, 24 bp, Homo sapiens
tacaccttgagcacaaacggaact

SEQ ID NO: 8981 - DNA, 24 bp, Homo sapiens
ctacaccttgagcacaaacggaac

SEQ ID NO: 8982 - DNA, 24 bp, Homo sapiens
gctacaccttgagcacaaacggaa

SEQ ID NO: 8983 - DNA, 24 bp, Homo sapiens
acgaagcaggcgtggccccccaac

SEQ ID NO: 8984 - DNA, 24 bp, Homo sapiens
cacgaagcaggcgtggccccccaa

SEQ ID NO: 8985 - DNA, 24 bp, Homo sapiens
acacgaagcaggcgtggcccccca

SEQ ID NO: 8986 - DNA, 24 bp, Homo sapiens
tcagaggagccagacagcaccact

SEQ ID NO: 8987 - DNA, 24 bp, Homo sapiens
gcaccagacccgaagaaccatcac

SEQ ID NO: 8988 - DNA, 24 bp, Homo sapiens
acttgtctgatgctaagcggtgga

SEQ ID NO: 8989 - DNA, 23 bp, Homo sapiens
caggctggtctcgaactgctgac

SEQ ID NO: 8990 - DNA, 23 bp, Homo sapiens
cacccacctcggtctcccaaagt

SEQ ID NO: 8991 - DNA, 23 bp, Homo sapiens
attacaggcgtgagccaccgcac

SEQ ID NO: 8992 - DNA, 24 bp, Homo sapiens
ttcctggtcctcctgctcccaaag

SEQ ID NO: 8993 - DNA, 24 bp, Homo sapiens
gttcccgactctgccccagccctg

SEQ ID NO: 8994 - DNA, 24 bp, Homo sapiens
catcctgcccaggagatgccaccc

SEQ ID NO: 8995 - DNA, 24 bp, Homo sapiens
agtgattctcctgcctcagcctcc

SEQ ID NO: 8996 - DNA, 23 bp, Homo sapiens
ctcacctcaacctccgcctcccg

SEQ ID NO: 8997 - DNA, 23 bp, Homo sapiens
caagctggagtgcaatggcgtga

SEQ ID NO: 8998 - DNA, 24 bp, Homo sapiens
ccagggtcctggtaagcttgatta

SEQ ID NO: 8999 - DNA, 24 bp, Homo sapiens
cccagggtcctggtaagcttgatt

SEQ ID NO: 9000 - DNA, 24 bp, Homo sapiens
acccagggtcctggtaagcttgat

SEQ ID NO: 9001 - DNA, 24 bp, Homo sapiens
cctgtgcgtgggagagacaggttt

SEQ ID NO: 9002 - DNA, 24 bp, Homo sapiens
tcctgtgcgtgggagagacaggtt

SEQ ID NO: 9003 - DNA, 24 bp, Homo sapiens
atcctgtgcgtgggagagacaggt

SEQ ID NO: 9004 - DNA, 23 bp, Homo sapiens
acagtcatgtggctcgcagatgc

SEQ ID NO: 9005 - DNA, 23 bp, Homo sapiens
gccctctcctctcttcctgccaa

SEQ ID NO: 9006 - DNA, 24 bp, Homo sapiens
gcccatctgctactctttcccacc

SEQ ID NO: 9007 - DNA, 23 bp, Homo sapiens
gccctctcctctcttcctgccaa

SEQ ID NO: 9008 - DNA, 23 bp, Homo sapiens
gcctccctttctctaatttcccc

SEQ ID NO: 9009 - DNA, 23 bp, Homo sapiens
atgcctggggggcatacaatcca

SEQ ID NO: 9010 - DNA, 23 bp, Homo sapiens
ggtgaataagtccgtcagccagg

SEQ ID NO: 9011 - DNA, 24 bp, Homo sapiens
catgtggggtttgacagcttgcct

SEQ ID NO: 9012 - DNA, 24 bp, Homo sapiens
cctgggagagaaggtggacgttgg

SEQ ID NO: 9013 - DNA, 24 bp, Homo sapiens
gcctgggagagaaggtggacgttg

SEQ ID NO: 9014 - DNA, 24 bp, Homo sapiens
ggcctgggagagaaggtggacgtt

SEQ ID NO: 9015 - DNA, 24 bp, Homo sapiens
ctttacggcaggagctggcacggg

SEQ ID NO: 9016 - DNA, 24 bp, Homo sapiens
tctttacggcaggagctggcacgg

SEQ ID NO: 9017 - DNA, 24 bp, Homo sapiens
atctttacggcaggagctggcacg

SEQ ID NO: 9018 - DNA, 24 bp, Homo sapiens
gcaatgacaatgacaccttcacgg

SEQ ID NO: 9019 - DNA, 24 bp, Homo sapiens
tcaagtgtgcccctggagtggtag

SEQ ID NO: 9020 - DNA, 24 bp, Homo sapiens
ggggctggcagctacaccattatg

SEQ ID NO: 9021 - DNA, 25 bp, Homo sapiens
accttggtctcactgtgtctcctag

SEQ ID NO: 9022 - DNA, 25 bp, Homo sapiens
aagattctctggtcaggttgttact

SEQ ID NO: 9023 - DNA, 25 bp, Homo sapiens
tggctctgaaattacagggaattgt

SEQ ID NO: 9024 - DNA, 25 bp, Homo sapiens
attgatagaagattgacgggtgcca

SEQ ID NO: 9025 - DNA, 25 bp, Homo sapiens
tgaacctctccagcaagttatccag

SEQ ID NO: 9026 - DNA, 25 bp, Homo sapiens
cacgcattgtagatgactttggcac

SEQ ID NO: 9027 - DNA, 25 bp, Homo sapiens
agaagcagtcagagataaggcagca

SEQ ID NO: 9028 - DNA, 25 bp, Homo sapiens
tgtgactcaagaatacagcgattgc

SEQ ID NO: 9029 - DNA, 25 bp, Homo sapiens
cctggacagcattcttgtagacaat

SEQ ID NO: 9030 - DNA, 24 bp, Homo sapiens
tcacctgaacaagtagccgactca

SEQ ID NO: 9031 - DNA, 25 bp, Homo sapiens
cagaggctgttccatgcagagataa

SEQ ID NO: 9032 - DNA, 25 bp, Homo sapiens
cgaatgagaacaagagtagcaggaa

SEQ ID NO: 9033 - DNA, 25 bp, Homo sapiens
gggctgagacaacacggaaaggtat

SEQ ID NO: 9034 - DNA, 25 bp, Homo sapiens
aaggtgacactccactctatgaagc

SEQ ID NO: 9035 - DNA, 25 bp, Homo sapiens
aagtctgtggttcttctcattctca

SEQ ID NO: 9036 - DNA, 24 bp, Homo sapiens
cgtcagtataggcatgggcagcag

SEQ ID NO: 9037 - DNA, 24 bp, Homo sapiens
acgtcagtataggcatgggcagca

SEQ ID NO: 9038 - DNA, 24 bp, Homo sapiens
aacgtcagtataggcatgggcagc

SEQ ID NO: 9039 - DNA, 24 bp, Homo sapiens
ggggctccgagggaacgtgctggc

SEQ ID NO: 9040 - DNA, 24 bp, Homo sapiens
tggggctccgagggaacgtgctgg

SEQ ID NO: 9041 - DNA, 24 bp, Homo sapiens
ctggggctccgagggaacgtgctg

SEQ ID NO: 9042 - DNA, 23 bp, Homo sapiens
ggcctgactgctgtagctgtgta

SEQ ID NO: 9043 - DNA, 24 bp, Homo sapiens
cgtggacccagggtggacaatgtc

SEQ ID NO: 9044 - DNA, 24 bp, Homo sapiens
ccgtggacccagggtggacaatgt

SEQ ID NO: 9045 - DNA, 24 bp, Homo sapiens
gccgtggacccagggtggacaatg

SEQ ID NO: 9046 - DNA, 24 bp, Homo sapiens
cgcttgaaggacatcatccaccgt

SEQ ID NO: 9047 - DNA, 24 bp, Homo sapiens
gagaacatcgtgatcgccgaggac

SEQ ID NO: 9048 - DNA, 25 bp, Homo sapiens
tcaagctgatagactttggctcggc

SEQ ID NO: 9049 - DNA, 24 bp, Homo sapiens
cgggaggagagcgaggatgaactg

SEQ ID NO: 9050 - DNA, 24 bp, Homo sapiens
gcgggaggagagcgaggatgaact

SEQ ID NO: 9051 - DNA, 24 bp, Homo sapiens
agcgggaggagagcgaggatgaac

SEQ ID NO: 9052 - DNA, 23 bp, Homo sapiens
gtacctgacgctggacggcttcg

SEQ ID NO: 9053 - DNA, 24 bp, Homo sapiens
atgacttcctgcccaactactgct

SEQ ID NO: 9054 - DNA, 25 bp, Homo sapiens
gaaatcaaccgcatgacccacaagc

SEQ ID NO: 9055 - DNA, 24 bp, Homo sapiens
caacatcctgtgaaagcagagatc

SEQ ID NO: 9056 - DNA, 24 bp, Homo sapiens
gcaacatcctgtgaaagcagagat

SEQ ID NO: 9057 - DNA, 24 bp, Homo sapiens
agcaacatcctgtgaaagcagaga

SEQ ID NO: 9058 - DNA, 24 bp, Homo sapiens
tatatctacaggttcgagaaatgg

SEQ ID NO: 9059 - DNA, 24 bp, Homo sapiens
ttatatctacaggttcgagaaatg

SEQ ID NO: 9060 - DNA, 24 bp, Homo sapiens
attatatctacaggttcgagaaat

SEQ ID NO: 9061 - DNA, 24 bp, Homo sapiens
agatgccaccgctgagatgctaga

SEQ ID NO: 9062 - DNA, 25 bp, Homo sapiens
ttcctacctcccttcctccagaact

SEQ ID NO: 9063 - DNA, 25 bp, Homo sapiens
cagtgggaagcagtcaagtgttagt

SEQ ID NO: 9064 - DNA, 25 bp, Homo sapiens
cagtgggaagcagtcaagtgttagt

SEQ ID NO: 9065 - DNA, 25 bp, Homo sapiens
acatgctgtaatatggatcaccgcc

SEQ ID NO: 9066 - DNA, 25 bp, Homo sapiens
aactacttcagcggttgccaaacag

SEQ ID NO: 9067 - DNA, 24 bp, Homo sapiens
gggattctctggccatttttgggc

SEQ ID NO: 9068 - DNA, 24 bp, Homo sapiens
agggattctctggccatttttggg

SEQ ID NO: 9069 - DNA, 24 bp, Homo sapiens
gagggattctctggccatttttgg

SEQ ID NO: 9070 - DNA, 25 bp, Homo sapiens
ggaaactggacatttggcactttgg

SEQ ID NO: 9071 - DNA, 25 bp, Homo sapiens
acagtcacagtaaagatggctctgg

SEQ ID NO: 9072 - DNA, 25 bp, Homo sapiens
ttggatcaaccatctcgttacctgg

SEQ ID NO: 9073 - DNA, 24 bp, Homo sapiens
tctcctccctcagcctcccaagta

SEQ ID NO: 9074 - DNA, 24 bp, Homo sapiens
aggtggagtttcgctcttgttgcc

SEQ ID NO: 9075 - DNA, 25 bp, Homo sapiens
aaagtgctgggattacaggtgcgag

SEQ ID NO: 9076 - DNA, 24 bp, Homo sapiens
tctcctccctcagcctcccaagta

SEQ ID NO: 9077 - DNA, 23 bp, Homo sapiens
cactgcaacctctgcccttcagg

SEQ ID NO: 9078 - DNA, 24 bp, Homo sapiens
gccaacattctggacgaagtgcca

SEQ ID NO: 9079 - DNA, 23 bp, Homo sapiens
ttccaagtgccattgccagtcat

SEQ ID NO: 9080 - DNA, 24 bp, Homo sapiens
gtgtctggtggaggtcctgattgc

SEQ ID NO: 9081 - DNA, 24 bp, Homo sapiens
gaggatgtaaggtctgaagctgcg

SEQ ID NO: 9082 - DNA, 24 bp, Homo sapiens
tgaggatgtaaggtctgaagctgc

SEQ ID NO: 9083 - DNA, 24 bp, Homo sapiens
ctgaggatgtaaggtctgaagctg

SEQ ID NO: 9084 - DNA, 24 bp, Homo sapiens
aagtcatacaggtctggaacaaaa

SEQ ID NO: 9085 - DNA, 24 bp, Homo sapiens
caagtcatacaggtctggaacaaa

SEQ ID NO: 9086 - DNA, 24 bp, Homo sapiens
acaagtcatacaggtctggaacaa

SEQ ID NO: 9087 - DNA, 24 bp, Homo sapiens
gaaaaccacagctcgacatggatt

SEQ ID NO: 9088 - DNA, 24 bp, Homo sapiens
agaaaaccacagctcgacatggat

SEQ ID NO: 9089 - DNA, 24 bp, Homo sapiens
cagaaaaccacagctcgacatgga

SEQ ID NO: 9090 - DNA, 24 bp, Homo sapiens
gtctgcagcagctcaaatcccagc

SEQ ID NO: 9091 - DNA, 24 bp, Homo sapiens
agtctgcagcagctcaaatcccag

SEQ ID NO: 9092 - DNA, 24 bp, Homo sapiens
cagtctgcagcagctcaaatccca

SEQ ID NO: 9093 - DNA, 24 bp, Homo sapiens
gtctctctcagccaacttcagttc

SEQ ID NO: 9094 - DNA, 24 bp, Homo sapiens
ggtctctctcagccaacttcagtt

SEQ ID NO: 9095 - DNA, 24 bp, Homo sapiens
aggtctctctcagccaacttcagt

SEQ ID NO: 9096 - DNA, 24 bp, Homo sapiens
atcttctccaggccagagcaaatc

SEQ ID NO: 9097 - DNA, 24 bp, Homo sapiens
catcttctccaggccagagcaaat

SEQ ID NO: 9098 - DNA, 24 bp, Homo sapiens
acatcttctccaggccagagcaaa

SEQ ID NO: 9099 - DNA, 24 bp, Homo sapiens
gagaataacagtgaggatcaaggt

SEQ ID NO: 9100 - DNA, 24 bp, Homo sapiens
agagaataacagtgaggatcaagg

SEQ ID NO: 9101 - DNA, 24 bp, Homo sapiens
aagagaataacagtgaggatcaag

SEQ ID NO: 9102 - DNA, 25 bp, Homo sapiens
cagtaacaagcaaggtgggcaagga

SEQ ID NO: 9103 - DNA, 25 bp, Homo sapiens
agtttcagcaagaatttcccagcct

SEQ ID NO: 9104 - DNA, 25 bp, Homo sapiens
atgatgacaactatggacctggacc

SEQ ID NO: 9105 - DNA, 23 bp, Homo sapiens
ctagacaagacagcaatcgcagt

SEQ ID NO: 9106 - DNA, 25 bp, Homo sapiens
accagaatcagggtctcaacctcgg

SEQ ID NO: 9107 - DNA, 23 bp, Homo sapiens
ttacctccacgattccagcggca

SEQ ID NO: 9108 - DNA, 24 bp, Homo sapiens
tacttccacagactgttccttcac

SEQ ID NO: 9109 - DNA, 24 bp, Homo sapiens
gtacttccacagactgttccttca

SEQ ID NO: 9110 - DNA, 24 bp, Homo sapiens
tgtacttccacagactgttccttc

SEQ ID NO: 9111 - DNA, 25 bp, Homo sapiens
acagtttcagaagtctttacctcca

SEQ ID NO: 9112 - DNA, 25 bp, Homo sapiens
accagaatcagggtctcaacctcgg

SEQ ID NO: 9113 - DNA, 25 bp, Homo sapiens
tcactagacaagacagcaatcgcag

SEQ ID NO: 9114 - DNA, 23 bp, Homo sapiens
ccctcctccaccacacagacctc

SEQ ID NO: 9115 - DNA, 23 bp, Homo sapiens
gcagcctcatcctcagcatttgg

SEQ ID NO: 9116 - DNA, 25 bp, Homo sapiens
aagcaacagaagagcctgaggatgt

SEQ ID NO: 9117 - DNA, 25 bp, Homo sapiens
acagtcttcagcctcagttccacct

SEQ ID NO: 9118 - DNA, 23 bp, Homo sapiens
cggctccacttccaccttcaacc

SEQ ID NO: 9119 - DNA, 23 bp, Homo sapiens
tcagcctcagcctcagtctcagc

SEQ ID NO: 9120 - DNA, 25 bp, Homo sapiens
acaggatgaagaacgccgaaagaag

SEQ ID NO: 9121 - DNA, 23 bp, Homo sapiens
gcacaccatcaggaaggagtacc

SEQ ID NO: 9122 - DNA, 25 bp, Homo sapiens
tggcaacaatggtccacccaaatca

SEQ ID NO: 9123 - DNA, 25 bp, Homo sapiens
ccctcttcttctttgcctaacaccg

SEQ ID NO: 9124 - DNA, 25 bp, Homo sapiens
caacaggtggagccagaaggacaag

SEQ ID NO: 9125 - DNA, 25 bp, Homo sapiens
aacaaagaacacaaacctggtccca

SEQ ID NO: 9126 - DNA, 23 bp, Homo sapiens
gggtgtggcaggaggttttggac

SEQ ID NO: 9127 - DNA, 25 bp, Homo sapiens
gcaacactcagtttatttaatactt

SEQ ID NO: 9128 - DNA, 25 bp, Homo sapiens
cagagcacaaaagcaaaggatggga

SEQ ID NO: 9129 - DNA, 23 bp, Homo sapiens
atggtggtaaggctgctggctca

SEQ ID NO: 9130 - DNA, 25 bp, Homo sapiens
ggtcctccacaggctaaactgaatg

SEQ ID NO: 9131 - DNA, 23 bp, Homo sapiens
aggctgctctcgcttcccagtat

SEQ ID NO: 9132 - DNA, 25 bp, Homo sapiens
catcttcacatctgccaccacctcc

SEQ ID NO: 9133 - DNA, 25 bp, Homo sapiens
ggcaggtgctcagatggaagtagat

SEQ ID NO: 9134 - DNA, 23 bp, Homo sapiens
tctgagcctgaacgcccatccat

SEQ ID NO: 9135 - DNA, 23 bp, Homo sapiens
aggctgctctcgcttcccagtat

SEQ ID NO: 9136 - DNA, 25 bp, Homo sapiens
ggtcctccacaggctaaactgaatg

SEQ ID NO: 9137 - DNA, 24 bp, Homo sapiens
ctgctggctcaccttcgtcatctg

SEQ ID NO: 9138 - DNA, 25 bp, Homo sapiens
ccctttccctccaagcagcaagtag

SEQ ID NO: 9139 - DNA, 25 bp, Homo sapiens
atggaagcaaagacgaagacaacaa

SEQ ID NO: 9140 - DNA, 23 bp, Homo sapiens
cggcgtgaagaggaagagcgaag

SEQ ID NO: 9141 - DNA, 23 bp, Homo sapiens
ccagttccagcctcaacctcagc

SEQ ID NO: 9142 - DNA, 23 bp, Homo sapiens
cctcaacctcagctccacttccg

SEQ ID NO: 9143 - DNA, 25 bp, Homo sapiens
ttagctccagttctggcctcaacct

SEQ ID NO: 9144 - DNA, 24 bp, Homo sapiens
tccaccttcaacctcagcttcagt

SEQ ID NO: 9145 - DNA, 24 bp, Homo sapiens
ttccaccttcaacctcagcttcag

SEQ ID NO: 9146 - DNA, 24 bp, Homo sapiens
cttccaccttcaacctcagcttca

SEQ ID NO: 9147 - DNA, 24 bp, Homo sapiens
tccagcctcacccttagctccagt

SEQ ID NO: 9148 - DNA, 24 bp, Homo sapiens
ttccagcctcacccttagctccag

SEQ ID NO: 9149 - DNA, 24 bp, Homo sapiens
gttccagcctcacccttagctcca

SEQ ID NO: 9150 - DNA, 25 bp, Homo sapiens
acagtcttcagcctcagttccacct

SEQ ID NO: 9151 - DNA, 25 bp, Homo sapiens
aggatgaagaacgccgaaagaagga

SEQ ID NO: 9152 - DNA, 23 bp, Homo sapiens
gcacaccatcaggaaggagtacc

SEQ ID NO: 9153 - DNA, 25 bp, Homo sapiens
cttcagttccagcctctacttcagc

SEQ ID NO: 9154 - DNA, 24 bp, Homo sapiens
tgtcaccattcttgcctcagcctc

SEQ ID NO: 9155 - DNA, 25 bp, Homo sapiens
ccagtcatcacagcaccaactatcc

SEQ ID NO: 9156 - DNA, 23 bp, Homo sapiens
agatgcctcctccgctgaccaca

SEQ ID NO: 9157 - DNA, 25 bp, Homo sapiens
cccacatactaacaccttcccagcg

SEQ ID NO: 9158 - DNA, 25 bp, Homo sapiens
ggtccttgtggatcactatctggag

SEQ ID NO: 9159 - DNA, 23 bp, Homo sapiens
tgtggcaggaggttttggactcg

SEQ ID NO: 9160 - DNA, 23 bp, Homo sapiens
cgaaatgtcggagaagtcaggcc

SEQ ID NO: 9161 - DNA, 25 bp, Homo sapiens
caaaagcaaaggatgggaaaaagta

SEQ ID NO: 9162 - DNA, 23 bp, Homo sapiens
gcgtatgcctccacctgctaacc

SEQ ID NO: 9163 - DNA, 25 bp, Homo sapiens
cagtaacaagcaaggtgggcaagga

SEQ ID NO: 9164 - DNA, 25 bp, Homo sapiens
agtttcagcaagaatttcccagcct

SEQ ID NO: 9165 - DNA, 25 bp, Homo sapiens
agtttcagcaagaatttcccagcct

SEQ ID NO: 9166 - DNA, 25 bp, Homo sapiens
atgatgacaactatggacctggacc

SEQ ID NO: 9167 - DNA, 24 bp, Homo sapiens
ctgctggctcaccttcgtcatctg

SEQ ID NO: 9168 - DNA, 25 bp, Homo sapiens
aatgatgacaactatggacctggac

SEQ ID NO: 9169 - DNA, 25 bp, Homo sapiens
agtttcagcaagaatttcccagcct

SEQ ID NO: 9170 - DNA, 24 bp, Homo sapiens
ctgctggctcaccttcgtcatctg

SEQ ID NO: 9171 - DNA, 23 bp, Homo sapiens
aggctgctctcgcttcccagtat

SEQ ID NO: 9172 - DNA, 25 bp, Homo sapiens
tgttccaacagtatccgaggatgac

SEQ ID NO: 9173 - DNA, 23 bp, Homo sapiens
tctgagcctgaacgcccatccat

SEQ ID NO: 9174 - DNA, 25 bp, Homo sapiens
ggcaggtgctcagatggaagtagat

SEQ ID NO: 9175 - DNA, 25 bp, Homo sapiens
ttcccaaatacctgcccaaccatca

SEQ ID NO: 9176 - DNA, 23 bp, Homo sapiens
aggctgctctcgcttcccagtat

SEQ ID NO: 9177 - DNA, 24 bp, Homo sapiens
ctgctggctcaccttcgtcatctg

SEQ ID NO: 9178 - DNA, 25 bp, Homo sapiens
atgatgacaactatggacctggacc

SEQ ID NO: 9179 - DNA, 25 bp, Homo sapiens
ttcccaaatacctgcccaaccatca

SEQ ID NO: 9180 - DNA, 25 bp, Homo sapiens
catcttcacatctgccaccacctcc

SEQ ID NO: 9181 - DNA, 23 bp, Homo sapiens
gcacagcagcatccacctccaga

SEQ ID NO: 9182 - DNA, 23 bp, Homo sapiens
tctgagcctgaacgcccatccat

SEQ ID NO: 9183 - DNA, 23 bp, Homo sapiens
aggctgctctcgcttcccagtat

SEQ ID NO: 9184 - DNA, 24 bp, Homo sapiens
ctgctggctcaccttcgtcatctg

SEQ ID NO: 9185 - DNA, 23 bp, Homo sapiens
ttcacatctgccaccacctccaa

SEQ ID NO: 9186 - DNA, 23 bp, Homo sapiens
gcagcagcagcaacagcaaggtg

SEQ ID NO: 9187 - DNA, 25 bp, Homo sapiens
tgttccttcacaaccgtccagtagt

SEQ ID NO: 9188 - DNA, 24 bp, Homo sapiens
cctcctccaccacacagacctctt

SEQ ID NO: 9189 - DNA, 24 bp, Homo sapiens
cctcctccaccacacagacctctt

SEQ ID NO: 9190 - DNA, 25 bp, Homo sapiens
tgttccttcacaaccgtccagtagt

SEQ ID NO: 9191 - DNA, 23 bp, Homo sapiens
gtggcagcagcagcaacagcaag

SEQ ID NO: 9192 - DNA, 25 bp, Homo sapiens
ccaggaacagattactgctgcttat

SEQ ID NO: 9193 - DNA, 25 bp, Homo sapiens
ttagaggctcacccaaaggcagact

SEQ ID NO: 9194 - DNA, 25 bp, Homo sapiens
tctgtggaagatgttagacctcacc

SEQ ID NO: 9195 - DNA, 25 bp, Homo sapiens
gagacaataagccaagagcagagca

SEQ ID NO: 9196 - DNA, 24 bp, Homo sapiens
cgaccagattcaagaccagcagtt

SEQ ID NO: 9197 - DNA, 23 bp, Homo sapiens
ggttcttatggagggcgtggcag

SEQ ID NO: 9198 - DNA, 25 bp, Homo sapiens
agcctcaacaagcaactactcccaa

SEQ ID NO: 9199 - DNA, 24 bp, Homo sapiens
cctcctccaccacacagacctctt

SEQ ID NO: 9200 - DNA, 25 bp, Homo sapiens
tgttccttcacaaccgtccagtagt

SEQ ID NO: 9201 - DNA, 25 bp, Homo sapiens
acagtcttcagcctcagttccacct

SEQ ID NO: 9202 - DNA, 23 bp, Homo sapiens
cggctccacttccaccttcaacc

SEQ ID NO: 9203 - DNA, 23 bp, Homo sapiens
tcagttccagcctcaacctcagc

SEQ ID NO: 9204 - DNA, 25 bp, Homo sapiens
acagtcttcagcctcagttccacct

SEQ ID NO: 9205 - DNA, 23 bp, Homo sapiens
cggctccacttccaccttcaacc

SEQ ID NO: 9206 - DNA, 23 bp, Homo sapiens
ccagttccagcctcaacctcagc

SEQ ID NO: 9207 - DNA, 23 bp, Homo sapiens
tcagcctcagcctcagtctcagc

SEQ ID NO: 9208 - DNA, 24 bp, Homo sapiens
tgtcaccattcttgcctcagcctc

SEQ ID NO: 9209 - DNA, 23 bp, Homo sapiens
ccagttccagcctcaacctcagc

SEQ ID NO: 9210 - DNA, 25 bp, Homo sapiens
tcagagggagcgaagaatggtcaag

SEQ ID NO: 9211 - DNA, 25 bp, Homo sapiens
aatgaagttgttcctgtgctttcgg

SEQ ID NO: 9212 - DNA, 23 bp, Homo sapiens
cagaagcagccacgagcaggacc

SEQ ID NO: 9213 - DNA, 24 bp, Homo sapiens
cacagccaccttcagtcagtgcat

SEQ ID NO: 9214 - DNA, 25 bp, Homo sapiens
aatgaagttgttcctgtgctttcgg

SEQ ID NO: 9215 - DNA, 23 bp, Homo sapiens
cagaagcagccacgagcaggacc

SEQ ID NO: 9216 - DNA, 25 bp, Homo sapiens
aacaaagaacacaaacctggtccca

SEQ ID NO: 9217 - DNA, 25 bp, Homo sapiens
acctaaagaacagcggcagaagcag

SEQ ID NO: 9218 - DNA, 25 bp, Homo sapiens
aatgaagttgttcctgtgctttcgg

SEQ ID NO: 9219 - DNA, 25 bp, Homo sapiens
aattcagtttggtgctccagcctca

SEQ ID NO: 9220 - DNA, 25 bp, Homo sapiens
caacaggtggagccagaaggacaag

SEQ ID NO: 9221 - DNA, 25 bp, Homo sapiens
aacaaagaacacaaacctggtccca

SEQ ID NO: 9222 - DNA, 25 bp, Homo sapiens
gctacagtcagaagcacagatcctg

SEQ ID NO: 9223 - DNA, 25 bp, Homo sapiens
acctaaagaacagcggcagaagcag

SEQ ID NO: 9224 - DNA, 25 bp, Homo sapiens
tcagagggagcgaagaatggtcaag

SEQ ID NO: 9225 - DNA, 23 bp, Homo sapiens
tccaccacagccaccttcagtca

SEQ ID NO: 9226 - DNA, 25 bp, Homo sapiens
caacaggtggagccagaaggacaag

SEQ ID NO: 9227 - DNA, 25 bp, Homo sapiens
aacaaagaacacaaacctggtccca

SEQ ID NO: 9228 - DNA, 23 bp, Homo sapiens
cagaagcagccacgagcaggacc

SEQ ID NO: 9229 - DNA, 25 bp, Homo sapiens
tctcagccaacttcagttcagcaga

SEQ ID NO: 9230 - DNA, 25 bp, Homo sapiens
gcaaagcagtttatcccagccatct

SEQ ID NO: 9231 - DNA, 25 bp, Homo sapiens
ttccaactgtccaacaccaagaact

SEQ ID NO: 9232 - DNA, 25 bp, Homo sapiens
acaagtacaacagcctggtcagaca

SEQ ID NO: 9233 - DNA, 23 bp, Homo sapiens
ggcaggcatcaggactaggaggt

SEQ ID NO: 9234 - DNA, 25 bp, Homo sapiens
ttccaactgtccaacaccaagaact

SEQ ID NO: 9235 - DNA, 24 bp, Homo sapiens
cggtgacagaggactttgtgttgc

SEQ ID NO: 9236 - DNA, 24 bp, Homo sapiens
ttcagtcaatgggaagttgcgggc

SEQ ID NO: 9237 - DNA, 24 bp, Homo sapiens
ggctgtgtctggatctgaggatgg

SEQ ID NO: 9238 - DNA, 24 bp, Homo sapiens
tcagtgaagaaattgaacgagagg

SEQ ID NO: 9239 - DNA, 24 bp, Homo sapiens
gtcagtgaagaaattgaacgagag

SEQ ID NO: 9240 - DNA, 24 bp, Homo sapiens
tgtcagtgaagaaattgaacgaga

SEQ ID NO: 9241 - DNA, 25 bp, Homo sapiens
agaacatgccttgacattcctaaga

SEQ ID NO: 9242 - DNA, 25 bp, Homo sapiens
agccttccctggatgatgtgagtgt

SEQ ID NO: 9243 - DNA, 25 bp, Homo sapiens
ctcatctcctgcctcaagtcctcca

SEQ ID NO: 9244 - DNA, 25 bp, Homo sapiens
cctggatgatgtgagtgtggttgac

SEQ ID NO: 9245 - DNA, 24 bp, Homo sapiens
tgcctcaagtcctccagctaagaa

SEQ ID NO: 9246 - DNA, 23 bp, Homo sapiens
gcaagcaagatggcaaatgtctg

SEQ ID NO: 9247 - DNA, 23 bp, Homo sapiens
acctgaggaagtggttgactaat

SEQ ID NO: 9248 - DNA, 24 bp, Homo sapiens
gagaaatggaaaggaatggaagaa

SEQ ID NO: 9249 - DNA, 23 bp, Homo sapiens
gagaaaactgagctgttctgcca

SEQ ID NO: 9250 - DNA, 24 bp, Homo sapiens
gtgtggaggagatgctggagatgc

SEQ ID NO: 9251 - DNA, 23 bp, Homo sapiens
aagcaagtaaccttcagacacag

SEQ ID NO: 9252 - DNA, 24 bp, Homo sapiens
ataccacccaacttgaagacctgc

SEQ ID NO: 9253 - DNA, 25 bp, Homo sapiens
cagtgccattgttagaagatacagc

SEQ ID NO: 9254 - DNA, 23 bp, Homo sapiens
tgttctcactcaggtcaatcagc

SEQ ID NO: 9255 - DNA, 25 bp, Homo sapiens
gatgacaatccgattctggtactgc

SEQ ID NO: 9256 - DNA, 24 bp, Homo sapiens
tgctcttatagggaacaccttcag

SEQ ID NO: 9257 - DNA, 24 bp, Homo sapiens
ctgctcttatagggaacaccttca

SEQ ID NO: 9258 - DNA, 24 bp, Homo sapiens
tctgctcttatagggaacaccttc

SEQ ID NO: 9259 - DNA, 24 bp, Homo sapiens
agcagccttctcctttactccaca

SEQ ID NO: 9260 - DNA, 24 bp, Homo sapiens
gtctccaacaccaagctaccgctc

SEQ ID NO: 9261 - DNA, 24 bp, Homo sapiens
ctcccaggttcccccactcatagc

SEQ ID NO: 9262 - DNA, 24 bp, Homo sapiens
cttccccacaggaccgtgaatagt

SEQ ID NO: 9263 - DNA, 24 bp, Homo sapiens
tcttccccacaggaccgtgaatag

SEQ ID NO: 9264 - DNA, 24 bp, Homo sapiens
ctcttccccacaggaccgtgaata

SEQ ID NO: 9265 - DNA, 24 bp, Homo sapiens
ggtggacacaaagccttcttcaga

SEQ ID NO: 9266 - DNA, 23 bp, Homo sapiens
gggtgttgctccagtctcaaggc

SEQ ID NO: 9267 - DNA, 25 bp, Homo sapiens
agggaggtttgtaaagcagatgccg

SEQ ID NO: 9268 - DNA, 24 bp, Homo sapiens
attgacgacaaactgttggtagag

SEQ ID NO: 9269 - DNA, 24 bp, Homo sapiens
cattgacgacaaactgttggtaga

SEQ ID NO: 9270 - DNA, 24 bp, Homo sapiens
gcattgacgacaaactgttggtag

SEQ ID NO: 9271 - DNA, 24 bp, Homo sapiens
atatttgtgtgagagaaatagccc

SEQ ID NO: 9272 - DNA, 24 bp, Homo sapiens
gatatttgtgtgagagaaatagcc

SEQ ID NO: 9273 - DNA, 24 bp, Homo sapiens
agatatttgtgtgagagaaatagc

SEQ ID NO: 9274 - DNA, 24 bp, Homo sapiens
aatcgatcaagggaacagagttca

SEQ ID NO: 9275 - DNA, 24 bp, Homo sapiens
aaatcgatcaagggaacagagttc

SEQ ID NO: 9276 - DNA, 24 bp, Homo sapiens
gaaatcgatcaagggaacagagtt

SEQ ID NO: 9277 - DNA, 24 bp, Homo sapiens
ctgcacataaggtctgtaaagtat

SEQ ID NO: 9278 - DNA, 24 bp, Homo sapiens
cctgcacataaggtctgtaaagta

SEQ ID NO: 9279 - DNA, 24 bp, Homo sapiens
tcctgcacataaggtctgtaaagt

SEQ ID NO: 9280 - DNA, 25 bp, Homo sapiens
tcatggaaggtgatggagttactca

SEQ ID NO: 9281 - DNA, 25 bp, Homo sapiens
aagaacagtccagactattgaggca

SEQ ID NO: 9282 - DNA, 25 bp, Homo sapiens
atgcacatgctagatttgatgagtt

SEQ ID NO: 9283 - DNA, 25 bp, Homo sapiens
caagtgattctcctgcctcagcctg

SEQ ID NO: 9284 - DNA, 24 bp, Homo sapiens
gatcttgactcactgcaacctctg

SEQ ID NO: 9285 - DNA, 23 bp, Homo sapiens
cttctccaggaacgcccaccagc

SEQ ID NO: 9286 - DNA, 24 bp, Homo sapiens
cacctgccacgacaacatctcaca

SEQ ID NO: 9287 - DNA, 23 bp, Homo sapiens
aacccagttccagccagtgaagc

SEQ ID NO: 9288 - DNA, 24 bp, Homo sapiens
gcattgggcaggtgtctgtgaaat

SEQ ID NO: 9289 - DNA, 24 bp, Homo sapiens
ggcattgggcaggtgtctgtgaaa

SEQ ID NO: 9290 - DNA, 24 bp, Homo sapiens
tggcattgggcaggtgtctgtgaa

SEQ ID NO: 9291 - DNA, 24 bp, Homo sapiens
tctttagaaagattggcagtagaa

SEQ ID NO: 9292 - DNA, 24 bp, Homo sapiens
ctctttagaaagattggcagtaga

SEQ ID NO: 9293 - DNA, 24 bp, Homo sapiens
actctttagaaagattggcagtag

SEQ ID NO: 9294 - DNA, 25 bp, Homo sapiens
tcttgcttccattgcttctccatca

SEQ ID NO: 9295 - DNA, 25 bp, Homo sapiens
gcaaagatcctcccaacaccaccag

SEQ ID NO: 9296 - DNA, 25 bp, Homo sapiens
gcactaaagcaagcagcaaaccagc

SEQ ID NO: 9297 - DNA, 23 bp, Homo sapiens
agtggtgtgggtactgggcgtcg

SEQ ID NO: 9298 - DNA, 25 bp, Homo sapiens
caaatcacttcttcccctgtctccc

SEQ ID NO: 9299 - DNA, 24 bp, Homo sapiens
gtgtctagcccagagggtactggt

SEQ ID NO: 9300 - DNA, 24 bp, Homo sapiens
tcaagcgcacctaacctacaggat

SEQ ID NO: 9301 - DNA, 25 bp, Homo sapiens
cgtactcatcgtaaaaagctgacct

SEQ ID NO: 9302 - DNA, 23 bp, Homo sapiens
tgtttagcacctcggtgctcggg

SEQ ID NO: 9303 - DNA, 25 bp, Homo sapiens
tgtctgtgatgtcaatggcttcagt

SEQ ID NO: 9304 - DNA, 23 bp, Homo sapiens
gatttgttacgggccaatggaca

SEQ ID NO: 9305 - DNA, 24 bp, Homo sapiens
aaattccatgaagtattatgatga

SEQ ID NO: 9306 - DNA, 25 bp, Homo sapiens
ctactaccagatacgctccagccag

SEQ ID NO: 9307 - DNA, 23 bp, Homo sapiens
agcgtgctccaggatgtcattcg

SEQ ID NO: 9308 - DNA, 23 bp, Homo sapiens
agtggtgacgatgatctggaggc

SEQ ID NO: 9309 - DNA, 24 bp, Homo sapiens
tgcctctcctggtgagtatgtaac

SEQ ID NO: 9310 - DNA, 24 bp, Homo sapiens
ctgcctctcctggtgagtatgtaa

SEQ ID NO: 9311 - DNA, 24 bp, Homo sapiens
cctgcctctcctggtgagtatgta

SEQ ID NO: 9312 - DNA, 24 bp, Homo sapiens
taggaatgaaggtggaaattcaga

SEQ ID NO: 9313 - DNA, 24 bp, Homo sapiens
ctaggaatgaaggtggaaattcag

SEQ ID NO: 9314 - DNA, 24 bp, Homo sapiens
tctaggaatgaaggtggaaattca

SEQ ID NO: 9315 - DNA, 24 bp, Homo sapiens
gctagaatacactatatgtgagac

SEQ ID NO: 9316 - DNA, 24 bp, Homo sapiens
agctagaatacactatatgtgaga

SEQ ID NO: 9317 - DNA, 24 bp, Homo sapiens
aagctagaatacactatatgtgag

SEQ ID NO: 9318 - DNA, 24 bp, Homo sapiens
agacaaccatcttcctcctcctcc

SEQ ID NO: 9319 - DNA, 24 bp, Homo sapiens
ggaacctgattctgaacagcagcc

SEQ ID NO: 9320 - DNA, 24 bp, Homo sapiens
gcaactgggaggaagatcggaaca

SEQ ID NO: 9321 - DNA, 24 bp, Homo sapiens
cgggatacaggacattgcctaaga

SEQ ID NO: 9322 - DNA, 24 bp, Homo sapiens
acgggatacaggacattgcctaag

SEQ ID NO: 9323 - DNA, 24 bp, Homo sapiens
tacgggatacaggacattgcctaa

SEQ ID NO: 9324 - DNA, 24 bp, Homo sapiens
ggtgtcagctggtggaggtcgaag

SEQ ID NO: 9325 - DNA, 24 bp, Homo sapiens
tggtgtcagctggtggaggtcgaa

SEQ ID NO: 9326 - DNA, 24 bp, Homo sapiens
ctggtgtcagctggtggaggtcga

SEQ ID NO: 9327 - DNA, 25 bp, Homo sapiens
tcgcttggttctaccttgccttcag

SEQ ID NO: 9328 - DNA, 24 bp, Homo sapiens
atgaatgccagcaaagaatctccc

SEQ ID NO: 9329 - DNA, 25 bp, Homo sapiens
ccctgaatttggtcaagcagaattt

SEQ ID NO: 9330 - DNA, 23 bp, Homo sapiens
ggtcacattccgcctccattcaa

SEQ ID NO: 9331 - DNA, 24 bp, Homo sapiens
accaacactccatgacccagacct

SEQ ID NO: 9332 - DNA, 25 bp, Homo sapiens
cggtagaacaagcatcggttgaagt

SEQ ID NO: 9333 - DNA, 24 bp, Homo sapiens
gccgcctccagcgccccatcctga

SEQ ID NO: 9334 - DNA, 24 bp, Homo sapiens
cgccgcctccagcgccccatcctg

SEQ ID NO: 9335 - DNA, 24 bp, Homo sapiens
ccgccgcctccagcgccccatcct

SEQ ID NO: 9336 - DNA, 24 bp, Homo sapiens
cgactgccactcccaacaattaaa

SEQ ID NO: 9337 - DNA, 25 bp, Homo sapiens
tctgataatgaggaagtgtttccca

SEQ ID NO: 9338 - DNA, 23 bp, Homo sapiens
actctggatcctcttgtcaatac

SEQ ID NO: 9339 - DNA, 25 bp, Homo sapiens
aggttgctttagacactcttgctgc

SEQ ID NO: 9340 - DNA, 25 bp, Homo sapiens
atgccaggagagctgtagacagagg

SEQ ID NO: 9341 - DNA, 24 bp, Homo sapiens
attcctgtgactggtcctgtggct

SEQ ID NO: 9342 - DNA, 24 bp, Homo sapiens
gactggtcctgtggctcagctcta

SEQ ID NO: 9343 - DNA, 24 bp, Homo sapiens
gaactcctgacctcgtgatccacc

SEQ ID NO: 9344 - DNA, 24 bp, Homo sapiens
gcctcttaaagtgctgggattaca

SEQ ID NO: 9345 - DNA, 24 bp, Homo sapiens
tgggacctcggcctcccaaagtgc

SEQ ID NO: 9346 - DNA, 24 bp, Homo sapiens
ttgggacctcggcctcccaaagtg

SEQ ID NO: 9347 - DNA, 24 bp, Homo sapiens
tttgggacctcggcctcccaaagt

SEQ ID NO: 9348 - DNA, 24 bp, Homo sapiens
agctgccgtggccctccagaatac

SEQ ID NO: 9349 - DNA, 24 bp, Homo sapiens
gagctgccgtggccctccagaata

SEQ ID NO: 9350 - DNA, 24 bp, Homo sapiens
tgagctgccgtggccctccagaat

SEQ ID NO: 9351 - DNA, 24 bp, Homo sapiens
atcccttggaggtgcccgaaatca

SEQ ID NO: 9352 - DNA, 24 bp, Homo sapiens
tatcccttggaggtgcccgaaatc

SEQ ID NO: 9353 - DNA, 24 bp, Homo sapiens
ttatcccttggaggtgcccgaaat

SEQ ID NO: 9354 - DNA, 25 bp, Homo sapiens
agtggacagactgatgcttagtgat

SEQ ID NO: 9355 - DNA, 25 bp, Homo sapiens
tgtcaagttggtttacaagaagggc

SEQ ID NO: 9356 - DNA, 25 bp, Homo sapiens
gcattcgtctattgtcgcacatcag

SEQ ID NO: 9357 - DNA, 25 bp, Homo sapiens
accttccagaggattacagcagcct

SEQ ID NO: 9358 - DNA, 23 bp, Homo sapiens
caggtggtgataagagcagagcc

SEQ ID NO: 9359 - DNA, 23 bp, Homo sapiens
gtgtgcggatctctgctgtgctc

SEQ ID NO: 9360 - DNA, 25 bp, Homo sapiens
atgtgacagatgaccacgacagaga

SEQ ID NO: 9361 - DNA, 24 bp, Homo sapiens
agtcgcagacctctcggttcagat

SEQ ID NO: 9362 - DNA, 25 bp, Homo sapiens
gcaccctgatctgtcttgtggaaca

SEQ ID NO: 9363 - DNA, 23 bp, Homo sapiens
agtagctgtgggcacattatgca

SEQ ID NO: 9364 - DNA, 23 bp, Homo sapiens
tcaagggcagaacagtccaaggc

SEQ ID NO: 9365 - DNA, 25 bp, Homo sapiens
acaggacgaggcatgtatgaactga

SEQ ID NO: 9366 - DNA, 23 bp, Homo sapiens
agcgcaacggaaattgaaaagac

SEQ ID NO: 9367 - DNA, 24 bp, Homo sapiens
tgcctccattctgccctctgtttg

SEQ ID NO: 9368 - DNA, 25 bp, Homo sapiens
ggatatgcctggtcagagtccatgc

SEQ ID NO: 9369 - DNA, 24 bp, Homo sapiens
cattttgcagtcagatgtcatgtt

SEQ ID NO: 9370 - DNA, 24 bp, Homo sapiens
gaagctggagtgcagaggttgcag

SEQ ID NO: 9371 - DNA, 24 bp, Homo sapiens
ggaagctggagtgcagaggttgca

SEQ ID NO: 9372 - DNA, 24 bp, Homo sapiens
aggaagctggagtgcagaggttgc

SEQ ID NO: 9373 - DNA, 24 bp, Homo sapiens
agatgtcttgttctgtgtgcccaa

SEQ ID NO: 9374 - DNA, 25 bp, Homo sapiens
cggaatgtggagaagaaatgggttc

SEQ ID NO: 9375 - DNA, 25 bp, Homo sapiens
ggatgtagtaatgcttcagacaggt

SEQ ID NO: 9376 - DNA, 25 bp, Homo sapiens
ggatgtagtaatgcttcagacaggt

SEQ ID NO: 9377 - DNA, 25 bp, Homo sapiens
acccataaggatgttgttcagcaga

SEQ ID NO: 9378 - DNA, 25 bp, Homo sapiens
tggagttggacaggtaaatgctaca

SEQ ID NO: 9379 - DNA, 25 bp, Homo sapiens
acccataaggatgttgttcagcaga

SEQ ID NO: 9380 - DNA, 25 bp, Homo sapiens
tggagttggacaggtaaatgctaca

SEQ ID NO: 9381 - DNA, 25 bp, Homo sapiens
tgaagatgagaacaaggagactggc

SEQ ID NO: 9382 - DNA, 25 bp, Homo sapiens
tggagttggacaggtaaatgctaca

SEQ ID NO: 9383 - DNA, 25 bp, Homo sapiens
gaagatgagaacaaggagactggca

SEQ ID NO: 9384 - DNA, 25 bp, Homo sapiens
acaggacgaggcatgtatgaactga

SEQ ID NO: 9385 - DNA, 25 bp, Homo sapiens
acaggacgaggcatgtatgaactga

SEQ ID NO: 9386 - DNA, 25 bp, Homo sapiens
agaacagtccaaggcagaagaagcg

SEQ ID NO: 9387 - DNA, 23 bp, Homo sapiens
ggtgttgcctccattctgccctc

SEQ ID NO: 9388 - DNA, 25 bp, Homo sapiens
agaacagtccaaggcagaagaagcg

SEQ ID NO: 9389 - DNA, 23 bp, Homo sapiens
ggtgttgcctccattctgccctc

SEQ ID NO: 9390 - DNA, 25 bp, Homo sapiens
ggatatgcctggtcagagtccatgc

SEQ ID NO: 9391 - DNA, 25 bp, Homo sapiens
acaggacgaggcatgtatgaactga

SEQ ID NO: 9392 - DNA, 25 bp, Homo sapiens
tgaagatgagaacaaggagactggc

SEQ ID NO: 9393 - DNA, 25 bp, Homo sapiens
tggagttggacaggtaaatgctaca

SEQ ID NO: 9394 - DNA, 24 bp, Homo sapiens
tgcctccattctgccctctgtttg

SEQ ID NO: 9395 - DNA, 24 bp, Homo sapiens
gaacataatggatatgcctggtca

SEQ ID NO: 9396 - DNA, 25 bp, Homo sapiens
catcatgggaacaattctgcaatgg

SEQ ID NO: 9397 - DNA, 23 bp, Homo sapiens
gagagttcacctaccagtcccgt

SEQ ID NO: 9398 - DNA, 23 bp, Homo sapiens
gagagttcacctaccagtcccgt

SEQ ID NO: 9399 - DNA, 25 bp, Homo sapiens
agaatgtcacggaagagcatgtagt

SEQ ID NO: 9400 - DNA, 25 bp, Homo sapiens
ggatatgcctggtcagagtccatgc

SEQ ID NO: 9401 - DNA, 25 bp, Homo sapiens
gcaccctgatctgtcttgtggaaca

SEQ ID NO: 9402 - DNA, 25 bp, Homo sapiens
aacagcgaaggcaacagagattacg

SEQ ID NO: 9403 - DNA, 25 bp, Homo sapiens
tgttattcctctgctgcttcctcca

SEQ ID NO: 9404 - DNA, 25 bp, Homo sapiens
ctgttattcctctgctgcttcctcc

SEQ ID NO: 9405 - DNA, 25 bp, Homo sapiens
aacagcgaaggcaacagagattacg

SEQ ID NO: 9406 - DNA, 25 bp, Homo sapiens
aaagtggaaagcagggcaatggtct

SEQ ID NO: 9407 - DNA, 23 bp, Homo sapiens
gtgtgcggatctctgctgtgctc

SEQ ID NO: 9408 - DNA, 23 bp, Homo sapiens
acacctactcctgtggctctgga

SEQ ID NO: 9409 - DNA, 23 bp, Homo sapiens
ggagaccgaccagggactcagac

SEQ ID NO: 9410 - DNA, 25 bp, Homo sapiens
gagcgattcaagaagattcagaagc

SEQ ID NO: 9411 - DNA, 23 bp, Homo sapiens
accaacacagtgtcacagaggaa

SEQ ID NO: 9412 - DNA, 25 bp, Homo sapiens
catgcacaggaagccaatcagacac

SEQ ID NO: 9413 - DNA, 23 bp, Homo sapiens
gtgatccatccgccttggccctc

SEQ ID NO: 9414 - DNA, 23 bp, Homo sapiens
ggccagggtggtctcgaactcct

SEQ ID NO: 9415 - DNA, 24 bp, Homo sapiens
gacctcacaggcacctcagccatc

SEQ ID NO: 9416 - DNA, 24 bp, Homo sapiens
tgacctcacaggcacctcagccat

SEQ ID NO: 9417 - DNA, 24 bp, Homo sapiens
atgacctcacaggcacctcagcca

SEQ ID NO: 9418 - DNA, 24 bp, Homo sapiens
caggtgttccagtccttacggaga

SEQ ID NO: 9419 - DNA, 24 bp, Homo sapiens
tggaggaatcttacaatggcagga

SEQ ID NO: 9420 - DNA, 24 bp, Homo sapiens
accaacaggagcaagagaaggaag

SEQ ID NO: 9421 - DNA, 24 bp, Homo sapiens
gcctccgccaaggatgagcacctg

SEQ ID NO: 9422 - DNA, 24 bp, Homo sapiens
ccaggtgttccagtccttacggag

SEQ ID NO: 9423 - DNA, 24 bp, Homo sapiens
tggaggaatcttacaatggcagga

SEQ ID NO: 9424 - DNA, 24 bp, Homo sapiens
aagcccgacaacccatcaggaaag

SEQ ID NO: 9425 - DNA, 24 bp, Homo sapiens
ttcccttccacccgaactgtcttg

SEQ ID NO: 9426 - DNA, 24 bp, Homo sapiens
gtcagggaagtagcaccagatggc

SEQ ID NO: 9427 - DNA, 24 bp, Homo sapiens
gtcaagcacagaggcaggttccac

SEQ ID NO: 9428 - DNA, 24 bp, Homo sapiens
gtcagggaagtagcaccagatggc

SEQ ID NO: 9429 - DNA, 24 bp, Homo sapiens
aagcccgacaacccatcaggaaag

SEQ ID NO: 9430 - DNA, 25 bp, Homo sapiens
atctgctggatcaggaagaaatggt

SEQ ID NO: 9431 - DNA, 25 bp, Homo sapiens
gaacattggctacaggttatgaagt

SEQ ID NO: 9432 - DNA, 25 bp, Homo sapiens
actgaagttgatgtgattgctgaac

SEQ ID NO: 9433 - DNA, 25 bp, Homo sapiens
actagcacttcacaatgtcaagaat

SEQ ID NO: 9434 - DNA, 25 bp, Homo sapiens
gctgggctcttctacatttgacaat

SEQ ID NO: 9435 - DNA, 25 bp, Homo sapiens
cagatacacaaatacaggagcacca

SEQ ID NO: 9436 - DNA, 25 bp, Homo sapiens
accatctactcaagcctcagcaatg

SEQ ID NO: 9437 - DNA, 25 bp, Homo sapiens
gctctcctgtatgtggtgtctgtag

SEQ ID NO: 9438 - DNA, 23 bp, Homo sapiens
ccacttgaggaggcagtctgtcc

SEQ ID NO: 9439 - DNA, 25 bp, Homo sapiens
caggagatgatattctggaagagga

SEQ ID NO: 9440 - DNA, 25 bp, Homo sapiens
atgattggaagtgtgtctggcagtg

SEQ ID NO: 9441 - DNA, 25 bp, Homo sapiens
tgatggaatggtctcctgatggtga

SEQ ID NO: 9442 - DNA, 24 bp, Homo sapiens
actaccacttccagcattgccagc

SEQ ID NO: 9443 - DNA, 25 bp, Homo sapiens
agtgtggtatcctatgactggttgg

SEQ ID NO: 9444 - DNA, 25 bp, Homo sapiens
tgctactgctggaaaggatgattgt

SEQ ID NO: 9445 - DNA, 25 bp, Homo sapiens
cacacttcattcactagcagcatca

SEQ ID NO: 9446 - DNA, 25 bp, Homo sapiens
acaccacctcatcccagtattgaag

SEQ ID NO: 9447 - DNA, 24 bp, Homo sapiens
tctccactaccactgcctaccacc

SEQ ID NO: 9448 - DNA, 24 bp, Homo sapiens
ttttccccaaggcactttaaaaat

SEQ ID NO: 9449 - DNA, 24 bp, Homo sapiens
tttttccccaaggcactttaaaaa

SEQ ID NO: 9450 - DNA, 24 bp, Homo sapiens
ttttttccccaaggcactttaaaa

SEQ ID NO: 9451 - DNA, 23 bp, Homo sapiens
gcactggagggataggatgggca

SEQ ID NO: 9452 - DNA, 24 bp, Homo sapiens
ctgagaaggatgctgatcggatgc

SEQ ID NO: 9453 - DNA, 23 bp, Homo sapiens
caggcttgctggcatacttggaa

SEQ ID NO: 9454 - DNA, 24 bp, Homo sapiens
ctccccatcaggtccagatgccac

SEQ ID NO: 9455 - DNA, 24 bp, Homo sapiens
cctccccatcaggtccagatgcca

SEQ ID NO: 9456 - DNA, 24 bp, Homo sapiens
acctccccatcaggtccagatgcc

SEQ ID NO: 9457 - DNA, 25 bp, Homo sapiens
attactcagccttcatctcagccag

SEQ ID NO: 9458 - DNA, 24 bp, Homo sapiens
ctcagcctcagccatttccacaga

SEQ ID NO: 9459 - DNA, 23 bp, Homo sapiens
aacctaagcttggcccacctcag

SEQ ID NO: 9460 - DNA, 25 bp, Homo sapiens
attactcagccttcatctcagccag

SEQ ID NO: 9461 - DNA, 25 bp, Homo sapiens
atcttattctcctcagcctcagcca

SEQ ID NO: 9462 - DNA, 24 bp, Homo sapiens
atgctcaacaggtggctggttcag

SEQ ID NO: 9463 - DNA, 24 bp, Homo sapiens
cctcagcctcagccatttccacag

SEQ ID NO: 9464 - DNA, 25 bp, Homo sapiens
attactcagccttcatctcagccag

SEQ ID NO: 9465 - DNA, 25 bp, Homo sapiens
tcaggtccagatgccactgtataac

SEQ ID NO: 9466 - DNA, 24 bp, Homo sapiens
tactgctttaggtgttagtggctt

SEQ ID NO: 9467 - DNA, 24 bp, Homo sapiens
atactgctttaggtgttagtggct

SEQ ID NO: 9468 - DNA, 24 bp, Homo sapiens
tatactgctttaggtgttagtggc

SEQ ID NO: 9469 - DNA, 24 bp, Homo sapiens
aggcttggcaggtaggaaaacatt

SEQ ID NO: 9470 - DNA, 24 bp, Homo sapiens
aaggcttggcaggtaggaaaacat

SEQ ID NO: 9471 - DNA, 24 bp, Homo sapiens
caaggcttggcaggtaggaaaaca

SEQ ID NO: 9472 - DNA, 24 bp, Homo sapiens
atgaagttgaggtgtattccagag

SEQ ID NO: 9473 - DNA, 24 bp, Homo sapiens
gatgaagttgaggtgtattccaga

SEQ ID NO: 9474 - DNA, 24 bp, Homo sapiens
tgatgaagttgaggtgtattccag

SEQ ID NO: 9475 - DNA, 24 bp, Homo sapiens
tgatgtcagattcccacctcctgt

SEQ ID NO: 9476 - DNA, 24 bp, Homo sapiens
tgaagttgaggtgtattccagagc

SEQ ID NO: 9477 - DNA, 24 bp, Homo sapiens
agagccttgctgttggtggttagc

SEQ ID NO: 9478 - DNA, 25 bp, Homo sapiens
acaacttggactcgacctatcatgc

SEQ ID NO: 9479 - DNA, 25 bp, Homo sapiens
aggctgggaagaaagaaaagatgct

SEQ ID NO: 9480 - DNA, 25 bp, Homo sapiens
cgcacatactatgtcaatcataaca

SEQ ID NO: 9481 - DNA, 23 bp, Homo sapiens
gcctcagctcgccaacagtaact

SEQ ID NO: 9482 - DNA, 23 bp, Homo sapiens
ctaatcgagcctcagatccgccg

SEQ ID NO: 9483 - DNA, 25 bp, Homo sapiens
acaacttggactcgacctatcatgc

SEQ ID NO: 9484 - DNA, 23 bp, Homo sapiens
cttcctcctcctcctctgcctcc

SEQ ID NO: 9485 - DNA, 25 bp, Homo sapiens
gccgaacttactatgtcaaccacaa

SEQ ID NO: 9486 - DNA, 24 bp, Homo sapiens
aatgactcggcttctcagcaccaa

SEQ ID NO: 9487 - DNA, 24 bp, Homo sapiens
aaaacagggctaatggactgctga

SEQ ID NO: 9488 - DNA, 24 bp, Homo sapiens
aaaaacagggctaatggactgctg

SEQ ID NO: 9489 - DNA, 24 bp, Homo sapiens
gaaaaacagggctaatggactgct

SEQ ID NO: 9490 - DNA, 24 bp, Homo sapiens
gatcggcacagtgctgccaagtct

SEQ ID NO: 9491 - DNA, 24 bp, Homo sapiens
agatcggcacagtgctgccaagtc

SEQ ID NO: 9492 - DNA, 24 bp, Homo sapiens
cagatcggcacagtgctgccaagt

SEQ ID NO: 9493 - DNA, 24 bp, Homo sapiens
ttctcgtggaggttatggacatca

SEQ ID NO: 9494 - DNA, 24 bp, Homo sapiens
cttctcgtggaggttatggacatc

SEQ ID NO: 9495 - DNA, 24 bp, Homo sapiens
tcttctcgtggaggttatggacat

SEQ ID NO: 9496 - DNA, 24 bp, Homo sapiens
aatattggagggtgttcgatgccg

SEQ ID NO: 9497 - DNA, 24 bp, Homo sapiens
aaatattggagggtgttcgatgcc

SEQ ID NO: 9498 - DNA, 24 bp, Homo sapiens
caaatattggagggtgttcgatgc

SEQ ID NO: 9499 - DNA, 23 bp, Homo sapiens
ccgccttcatcaccaccatagcc

SEQ ID NO: 9500 - DNA, 23 bp, Homo sapiens
cctctcgctcattgccaccgcca

SEQ ID NO: 9501 - DNA, 23 bp, Homo sapiens
aacaacttgccaacatcacaatg

SEQ ID NO: 9502 - DNA, 24 bp, Homo sapiens
acttggcacagatcccacccatgt

SEQ ID NO: 9503 - DNA, 24 bp, Homo sapiens
aacttggcacagatcccacccatg

SEQ ID NO: 9504 - DNA, 24 bp, Homo sapiens
aaacttggcacagatcccacccat

SEQ ID NO: 9505 - DNA, 24 bp, Homo sapiens
atggctgaggagtactgccacaaa

SEQ ID NO: 9506 - DNA, 24 bp, Homo sapiens
gatggctgaggagtactgccacaa

SEQ ID NO: 9507 - DNA, 24 bp, Homo sapiens
ggatggctgaggagtactgccaca

SEQ ID NO: 9508 - DNA, 25 bp, Homo sapiens
caggatgatctcaccgtggtactca

SEQ ID NO: 9509 - DNA, 24 bp, Homo sapiens
aaatgtgccctgaactggacggac

SEQ ID NO: 9510 - DNA, 24 bp, Homo sapiens
agcaccagcctccctacatcattg

SEQ ID NO: 9511 - DNA, 25 bp, Homo sapiens
tccgaacatttgaaccgaggcttct

SEQ ID NO: 9512 - DNA, 24 bp, Homo sapiens
tcattgcagtgttgcctcgatatg

SEQ ID NO: 9513 - DNA, 24 bp, Homo sapiens
aagcattgaattgcaaaggccccg

SEQ ID NO: 9514 - DNA, 24 bp, Homo sapiens
ctctgccaccatcactgtcaccaa

SEQ ID NO: 9515 - DNA, 24 bp, Homo sapiens
cactgctactgtcactgctactgc

SEQ ID NO: 9516 - DNA, 24 bp, Homo sapiens
gccaccaccacaactactaccact

SEQ ID NO: 9517 - DNA, 24 bp, Homo sapiens
ccaagctccaggtgcagccttcag

SEQ ID NO: 9518 - DNA, 24 bp, Homo sapiens
tccaagctccaggtgcagccttca

SEQ ID NO: 9519 - DNA, 24 bp, Homo sapiens
ctccaagctccaggtgcagccttc

SEQ ID NO: 9520 - DNA, 24 bp, Homo sapiens
aagattgcaacgacctcctcaaag

SEQ ID NO: 9521 - DNA, 24 bp, Homo sapiens
caagattgcaacgacctcctcaaa

SEQ ID NO: 9522 - DNA, 24 bp, Homo sapiens
tcaagattgcaacgacctcctcaa

SEQ ID NO: 9523 - DNA, 24 bp, Homo sapiens
aagaacttaagggacagatgttaa

SEQ ID NO: 9524 - DNA, 24 bp, Homo sapiens
gaagaacttaagggacagatgtta

SEQ ID NO: 9525 - DNA, 24 bp, Homo sapiens
ggaagaacttaagggacagatgtt

SEQ ID NO: 9526 - DNA, 24 bp, Homo sapiens
tatgccaccaggtaagataagttc

SEQ ID NO: 9527 - DNA, 24 bp, Homo sapiens
ctatgccaccaggtaagataagtt

SEQ ID NO: 9528 - DNA, 24 bp, Homo sapiens
actatgccaccaggtaagataagt

SEQ ID NO: 9529 - DNA, 24 bp, Homo sapiens
gacagaaaacgccacgaggcaagt

SEQ ID NO: 9530 - DNA, 24 bp, Homo sapiens
agacagaaaacgccacgaggcaag

SEQ ID NO: 9531 - DNA, 24 bp, Homo sapiens
cagacagaaaacgccacgaggcaa

SEQ ID NO: 9532 - DNA, 24 bp, Homo sapiens
ccacatagcaggtccacaaaaggt

SEQ ID NO: 9533 - DNA, 24 bp, Homo sapiens
tccacatagcaggtccacaaaagg

SEQ ID NO: 9534 - DNA, 24 bp, Homo sapiens
gtccacatagcaggtccacaaaag

SEQ ID NO: 9535 - DNA, 24 bp, Homo sapiens
ctcggcataaggaccacgcagcag

SEQ ID NO: 9536 - DNA, 24 bp, Homo sapiens
actcggcataaggaccacgcagca

SEQ ID NO: 9537 - DNA, 24 bp, Homo sapiens
tactcggcataaggaccacgcagc

SEQ ID NO: 9538 - DNA, 24 bp, Homo sapiens
cggtgcctgaacatgcaggagaaa

SEQ ID NO: 9539 - DNA, 24 bp, Homo sapiens
tcggtgcctgaacatgcaggagaa

SEQ ID NO: 9540 - DNA, 24 bp, Homo sapiens
atcggtgcctgaacatgcaggaga

SEQ ID NO: 9541 - DNA, 24 bp, Homo sapiens
ctcggcatgaggtgagaggaatgt

SEQ ID NO: 9542 - DNA, 24 bp, Homo sapiens
tctcggcatgaggtgagaggaatg

SEQ ID NO: 9543 - DNA, 24 bp, Homo sapiens
ttctcggcatgaggtgagaggaat

SEQ ID NO: 9544 - DNA, 25 bp, Homo sapiens
gcctatgtaaaactcacagaaaatg

SEQ ID NO: 9545 - DNA, 24 bp, Homo sapiens
ggcagcatctcctggacctcattg

SEQ ID NO: 9546 - DNA, 23 bp, Homo sapiens
gaggacctggctcgctcacatcg

SEQ ID NO: 9547 - DNA, 25 bp, Homo sapiens
gccaagccaatagtctacgattcct

SEQ ID NO: 9548 - DNA, 23 bp, Homo sapiens
agctcctccccacgccttcggcc

SEQ ID NO: 9549 - DNA, 23 bp, Homo sapiens
tggcggaagggacagaggacctg

SEQ ID NO: 9550 - DNA, 23 bp, Homo sapiens
gctgctgacggtgaccgaggtcg

SEQ ID NO: 9551 - DNA, 24 bp, Homo sapiens
tttgggaagagttggagaagcggg

SEQ ID NO: 9552 - DNA, 25 bp, Homo sapiens
cggaattggtggacttggagacagt

SEQ ID NO: 9553 - DNA, 25 bp, Homo sapiens
ccaagactgctagatcctgaagacg

SEQ ID NO: 9554 - DNA, 23 bp, Homo sapiens
ccgtctgctctcactgctggttc

SEQ ID NO: 9555 - DNA, 24 bp, Homo sapiens
gggaggagagagtcagtggagcag

SEQ ID NO: 9556 - DNA, 24 bp, Homo sapiens
cacatcagagctacacctaatgaa

SEQ ID NO: 9557 - DNA, 25 bp, Homo sapiens
gttggagaaggtactgcggattgct

SEQ ID NO: 9558 - DNA, 24 bp, Homo sapiens
ggagattggaagaagcatgtggaa

SEQ ID NO: 9559 - DNA, 25 bp, Homo sapiens
gtcgcttgatgaagaagtttgagga

SEQ ID NO: 9560 - DNA, 25 bp, Homo sapiens
tcagcagcattgtaggattagaaga

SEQ ID NO: 9561 - DNA, 25 bp, Homo sapiens
ttgttaccactggagaatctgctcg

SEQ ID NO: 9562 - DNA, 25 bp, Homo sapiens
gcacagtgtctggaaggaacaatcc

SEQ ID NO: 9563 - DNA, 25 bp, Homo sapiens
tcagcagcattgtaggattagaaga

SEQ ID NO: 9564 - DNA, 25 bp, Homo sapiens
ttgttaccactggagaatctgctcg

SEQ ID NO: 9565 - DNA, 24 bp, Homo sapiens
gcacagtgtctggaaggaacaatc

SEQ ID NO: 9566 - DNA, 25 bp, Homo sapiens
tgatgcagtgactcaagaaggacaa

SEQ ID NO: 9567 - DNA, 25 bp, Homo sapiens
aggctcttcaagactgtgcttcaga

SEQ ID NO: 9568 - DNA, 25 bp, Homo sapiens
aacttgggagagagtaaacagcaca

SEQ ID NO: 9569 - DNA, 23 bp, Homo sapiens
aaggacaagctgccagcaagagc

SEQ ID NO: 9570 - DNA, 24 bp, Homo sapiens
agaagctccagtctgtccttgagg

SEQ ID NO: 9571 - DNA, 25 bp, Homo sapiens
caatcgcctctatgatctgccagca

SEQ ID NO: 9572 - DNA, 25 bp, Homo sapiens
aacaggcatccgtgaacaccataat

SEQ ID NO: 9573 - DNA, 25 bp, Homo sapiens
aaggaggaatcgcctgaacacaagg

SEQ ID NO: 9574 - DNA, 25 bp, Homo sapiens
gccgtcagtctaacaacctgtgctt

SEQ ID NO: 9575 - DNA, 23 bp, Homo sapiens
ttgacctaacagccacgcagagc

SEQ ID NO: 9576 - DNA, 23 bp, Homo sapiens
ggcagagcagtctccagcaacaa

SEQ ID NO: 9577 - DNA, 25 bp, Homo sapiens
acaggaattagccgagcagaagagt

SEQ ID NO: 9578 - DNA, 23 bp, Homo sapiens
tggaggtggtggaaagcagcatc

SEQ ID NO: 9579 - DNA, 23 bp, Homo sapiens
gtggaggagaacgaggacaggct

SEQ ID NO: 9580 - DNA, 23 bp, Homo sapiens
ccgcataacactctaccagcatt

SEQ ID NO: 9581 - DNA, 24 bp, Homo sapiens
ccagttgagcctgctgaaggacac

SEQ ID NO: 9582 - DNA, 25 bp, Homo sapiens
gaagaactatgccaccagctctcct

SEQ ID NO: 9583 - DNA, 25 bp, Homo sapiens
aatgggagaacgacttgctaaagcc

SEQ ID NO: 9584 - DNA, 23 bp, Homo sapiens
ggagctggacagatgacttgacc

SEQ ID NO: 9585 - DNA, 23 bp, Homo sapiens
gcctgctgaaggacaccctctct

SEQ ID NO: 9586 - DNA, 25 bp, Homo sapiens
cagtgctgatgatatctccattctt

SEQ ID NO: 9587 - DNA, 24 bp, Homo sapiens
ggcagcatctcctggacctcattg

SEQ ID NO: 9588 - DNA, 24 bp, Homo sapiens
gccgtgcagcagcttgataagaac

SEQ ID NO: 9589 - DNA, 23 bp, Homo sapiens
gaggacctggctcgctcacatcg

SEQ ID NO: 9590 - DNA, 23 bp, Homo sapiens
gaggacctggctcgctcacatcg

SEQ ID NO: 9591 - DNA, 24 bp, Homo sapiens
gcagcagcttgataagaacatgag

SEQ ID NO: 9592 - DNA, 23 bp, Homo sapiens
gtaactcggaagaaatacagaga

SEQ ID NO: 9593 - DNA, 25 bp, Homo sapiens
gccaagccaatagtctacgattcct

SEQ ID NO: 9594 - DNA, 23 bp, Homo sapiens
gaggacctggctcgctcacatcg

SEQ ID NO: 9595 - DNA, 24 bp, Homo sapiens
gccgtgcagcagcttgataagaac

SEQ ID NO: 9596 - DNA, 24 bp, Homo sapiens
ctgaaatcatgagtctggtgctgg

SEQ ID NO: 9597 - DNA, 24 bp, Homo sapiens
gctgaaatcatgagtctggtgctg

SEQ ID NO: 9598 - DNA, 24 bp, Homo sapiens
ggctgaaatcatgagtctggtgct

SEQ ID NO: 9599 - DNA, 24 bp, Homo sapiens
atgttcgtccagtaccagtgccac

SEQ ID NO: 9600 - DNA, 24 bp, Homo sapiens
gggcaagcaagctgtcttctttgt

SEQ ID NO: 9601 - DNA, 24 bp, Homo sapiens
gcagattcccaagatgttcacgag

SEQ ID NO: 9602 - DNA, 24 bp, Homo sapiens
gtccagtaccagtgccacgcagtt

SEQ ID NO: 9603 - DNA, 24 bp, Homo sapiens
gggcaagcaagctgtcttctttgt

SEQ ID NO: 9604 - DNA, 24 bp, Homo sapiens
cagattcccaagatgttcacgagc

SEQ ID NO: 9605 - DNA, 24 bp, Homo sapiens
cccttcgtgaatggttcggctgaa

SEQ ID NO: 9606 - DNA, 24 bp, Homo sapiens
gctggcagaaagtagtcctggaag

SEQ ID NO: 9607 - DNA, 24 bp, Homo sapiens
agaagcagcaacaaatggcagcac

SEQ ID NO: 9608 - DNA, 23 bp, Homo sapiens
caggctggtctcgaactcgtgag

SEQ ID NO: 9609 - DNA, 23 bp, Homo sapiens
cagtctgcccacctctgcctccc

SEQ ID NO: 9610 - DNA, 24 bp, Homo sapiens
cgatgtggccggtcttttatcaga

SEQ ID NO: 9611 - DNA, 24 bp, Homo sapiens
tcgatgtggccggtcttttatcag

SEQ ID NO: 9612 - DNA, 24 bp, Homo sapiens
ctcgatgtggccggtcttttatca

SEQ ID NO: 9613 - DNA, 24 bp, Homo sapiens
agaagggcaagatcaccgttctgc

SEQ ID NO: 9614 - DNA, 24 bp, Homo sapiens
gagaagggcaagatcaccgttctg

SEQ ID NO: 9615 - DNA, 24 bp, Homo sapiens
tgagaagggcaagatcaccgttct

SEQ ID NO: 9616 - DNA, 24 bp, Homo sapiens
gtgggctaaaggactgtcatgtgc

SEQ ID NO: 9617 - DNA, 24 bp, Homo sapiens
tgtgggctaaaggactgtcatgtg

SEQ ID NO: 9618 - DNA, 24 bp, Homo sapiens
ttgtgggctaaaggactgtcatgt

SEQ ID NO: 9619 - DNA, 24 bp, Homo sapiens
gtggcatggagcttctagtgaaca

SEQ ID NO: 9620 - DNA, 24 bp, Homo sapiens
agtggcatggagcttctagtgaac

SEQ ID NO: 9621 - DNA, 24 bp, Homo sapiens
cagtggcatggagcttctagtgaa

SEQ ID NO: 9622 - DNA, 25 bp, Homo sapiens
actcctgaagcaagcagattccagc

SEQ ID NO: 9623 - DNA, 25 bp, Homo sapiens
gtgcggatgaattacagtggagacc

SEQ ID NO: 9624 - DNA, 25 bp, Homo sapiens
tggagaaggcagtggagatgacaga

SEQ ID NO: 9625 - DNA, 25 bp, Homo sapiens
gcgatgccacagaggagttcattga

SEQ ID NO: 9626 - DNA, 25 bp, Homo sapiens
gcttaacagactcgcagggatcaga

SEQ ID NO: 9627 - DNA, 25 bp, Homo sapiens
ggacgccaccttctaacagtgctac

SEQ ID NO: 9628 - DNA, 25 bp, Homo sapiens
gctgtagccgactagatagaactga

SEQ ID NO: 9629 - DNA, 25 bp, Homo sapiens
acagcaatgatgaaatccgccaagc

SEQ ID NO: 9630 - DNA, 25 bp, Homo sapiens
gcagtcatctacagatcaagcctca

SEQ ID NO: 9631 - DNA, 23 bp, Homo sapiens
aggagttggcggtggaagaggaa

SEQ ID NO: 9632 - DNA, 25 bp, Homo sapiens
cttacttggctgatgtcacgaatgc

SEQ ID NO: 9633 - DNA, 25 bp, Homo sapiens
tcataatgctgctgtggattggctg

SEQ ID NO: 9634 - DNA, 25 bp, Homo sapiens
gatgccattcagaccaacttccagc

SEQ ID NO: 9635 - DNA, 25 bp, Homo sapiens
tggagaaggcagtggagatgacaga

SEQ ID NO: 9636 - DNA, 25 bp, Homo sapiens
gtgcggatgaattacagtggagacc

SEQ ID NO: 9637 - DNA, 25 bp, Homo sapiens
gtgcggatgaattacagtggagacc

SEQ ID NO: 9638 - DNA, 23 bp, Homo sapiens
atcagtgctcatgtgctcaggcg

SEQ ID NO: 9639 - DNA, 25 bp, Homo sapiens
actcctgaagcaagcagattccagc

SEQ ID NO: 9640 - DNA, 23 bp, Homo sapiens
aagccgtgtggttacctggttca

SEQ ID NO: 9641 - DNA, 25 bp, Homo sapiens
aggctctgtttcggatcacttggtt

SEQ ID NO: 9642 - DNA, 24 bp, Homo sapiens
ctcagttggcaacggggaacttca

SEQ ID NO: 9643 - DNA, 24 bp, Homo sapiens
gcccagcagtgtcatcagcatcat

SEQ ID NO: 9644 - DNA, 24 bp, Homo sapiens
atgagcagcagcggacaacaatga

SEQ ID NO: 9645 - DNA, 24 bp, Homo sapiens
ggtgccgctggtagttatggtgaa

SEQ ID NO: 9646 - DNA, 23 bp, Homo sapiens
cagcgaaccatcaactggcagaa

SEQ ID NO: 9647 - DNA, 24 bp, Homo sapiens
cctgatggagcacctgaaagcctg

SEQ ID NO: 9648 - DNA, 25 bp, Homo sapiens
aacttctgctcttcatctgtggatc

SEQ ID NO: 9649 - DNA, 25 bp, Homo sapiens
gcttaacagactcgcagggatcaga

SEQ ID NO: 9650 - DNA, 25 bp, Homo sapiens
gcgatgccacagaggagttcattga

SEQ ID NO: 9651 - DNA, 24 bp, Homo sapiens
cctcctggaagatgacagtggcat

SEQ ID NO: 9652 - DNA, 24 bp, Homo sapiens
aaaaatctgaggtatttatttttg

SEQ ID NO: 9653 - DNA, 24 bp, Homo sapiens
gaaaaatctgaggtatttattttt

SEQ ID NO: 9654 - DNA, 24 bp, Homo sapiens
agaaaaatctgaggtatttatttt

SEQ ID NO: 9655 - DNA, 24 bp, Homo sapiens
gaatcaaaaatgcggtgcgtcttt

SEQ ID NO: 9656 - DNA, 24 bp, Homo sapiens
ggaatcaaaaatgcggtgcgtctt

SEQ ID NO: 9657 - DNA, 24 bp, Homo sapiens
aggaatcaaaaatgcggtgcgtct

SEQ ID NO: 9658 - DNA, 23 bp, Homo sapiens
caatggcacgatctcggctcact

SEQ ID NO: 9659 - DNA, 24 bp, Homo sapiens
tgtgattctcctgcctcagcctcc

SEQ ID NO: 9660 - DNA, 24 bp, Homo sapiens
aagtgctaggattacaggcgtgag

SEQ ID NO: 9661 - DNA, 25 bp, Homo sapiens
aagtgatcctgctgcctctgtctct

SEQ ID NO: 9662 - DNA, 23 bp, Homo sapiens
caaagtgctgggagccaccacgc

SEQ ID NO: 9663 - DNA, 23 bp, Homo sapiens
tgcccaggctggtctctaactcc

SEQ ID NO: 9664 - DNA, 24 bp, Homo sapiens
agttcagcagattcttcaaccagc

SEQ ID NO: 9665 - DNA, 24 bp, Homo sapiens
tacagtgaagacttctggcagtgg

SEQ ID NO: 9666 - DNA, 24 bp, Homo sapiens
cagttgtgctctcctgtggataat

SEQ ID NO: 9667 - DNA, 25 bp, Homo sapiens
gccaacagaaagggagaaggtgaag

SEQ ID NO: 9668 - DNA, 24 bp, Homo sapiens
aatcaggctgtcaaggaggcagaa

SEQ ID NO: 9669 - DNA, 23 bp, Homo sapiens
cgtcgccttgatacctccagcct

SEQ ID NO: 9670 - DNA, 24 bp, Homo sapiens
ggtcttgatgacagtggagagcac

SEQ ID NO: 9671 - DNA, 25 bp, Homo sapiens
ttagaactggaactggtgacattgc

SEQ ID NO: 9672 - DNA, 25 bp, Homo sapiens
ccaagatacagaacagcctctcagg

SEQ ID NO: 9673 - DNA, 25 bp, Homo sapiens
aggaccgatgtatctgtgacaagca

SEQ ID NO: 9674 - DNA, 25 bp, Homo sapiens
ccatcagggctaaccacttcacacc

SEQ ID NO: 9675 - DNA, 23 bp, Homo sapiens
caacagcctgcccagatccctct

SEQ ID NO: 9676 - DNA, 25 bp, Homo sapiens
aagactcaagccagacatcacggtt

SEQ ID NO: 9677 - DNA, 23 bp, Homo sapiens
caccatcgcccgctctctaccaa

SEQ ID NO: 9678 - DNA, 24 bp, Homo sapiens
tcccagagtcaccaaactaccgca

SEQ ID NO: 9679 - DNA, 25 bp, Homo sapiens
gttctgggccttcttgaaatattcc

SEQ ID NO: 9680 - DNA, 23 bp, Homo sapiens
acctcggcaaattccgacgtctt

SEQ ID NO: 9681 - DNA, 25 bp, Homo sapiens
aatttggacattgaccccaaactgc

SEQ ID NO: 9682 - DNA, 25 bp, Homo sapiens
acattattagtgctgctcctccagg

SEQ ID NO: 9683 - DNA, 25 bp, Homo sapiens
tccacctcagtattacggcgttcca

SEQ ID NO: 9684 - DNA, 23 bp, Homo sapiens
cagccagtcagcaagcagcatca

SEQ ID NO: 9685 - DNA, 25 bp, Homo sapiens
acattattagtgctgctcctccagg

SEQ ID NO: 9686 - DNA, 23 bp, Homo sapiens
cattagcagcagctcagcagcca

SEQ ID NO: 9687 - DNA, 25 bp, Homo sapiens
tttgactacaattcccagcagcagc

SEQ ID NO: 9688 - DNA, 25 bp, Homo sapiens
tccacctcagtattacggcgttcca

SEQ ID NO: 9689 - DNA, 23 bp, Homo sapiens
cagccagtcagcaagcagcatca

SEQ ID NO: 9690 - DNA, 24 bp, Homo sapiens
agcaggtcagcgtcctcttactcc

SEQ ID NO: 9691 - DNA, 23 bp, Homo sapiens
cagccagtcagcaagcagcatca

SEQ ID NO: 9692 - DNA, 25 bp, Homo sapiens
tccagccaacttatttcagcagcaa

SEQ ID NO: 9693 - DNA, 25 bp, Homo sapiens
tccacctcagtattacggcgttcca

SEQ ID NO: 9694 - DNA, 25 bp, Homo sapiens
agcaacagcagccaagcactaatct

SEQ ID NO: 9695 - DNA, 25 bp, Homo sapiens
acctggtcaacctggaagtacatct

SEQ ID NO: 9696 - DNA, 25 bp, Homo sapiens
ctcagccctcagtggatttggttca

SEQ ID NO: 9697 - DNA, 24 bp, Homo sapiens
ctgtttcccagctcgcccagtgac

SEQ ID NO: 9698 - DNA, 24 bp, Homo sapiens
cctgtttcccagctcgcccagtga

SEQ ID NO: 9699 - DNA, 24 bp, Homo sapiens
ccctgtttcccagctcgcccagtg

SEQ ID NO: 9700 - DNA, 24 bp, Homo sapiens
ttcggtcctagcaagtgggagaac

SEQ ID NO: 9701 - DNA, 24 bp, Homo sapiens
tttcggtcctagcaagtgggagaa

SEQ ID NO: 9702 - DNA, 24 bp, Homo sapiens
ttttcggtcctagcaagtgggaga

SEQ ID NO: 9703 - DNA, 24 bp, Homo sapiens
aactagaagctaaggtgaagaagc

SEQ ID NO: 9704 - DNA, 24 bp, Homo sapiens
gaagacacaggaaaggcttgacga

SEQ ID NO: 9705 - DNA, 24 bp, Homo sapiens
tctgaaggaactctggctctgtgt

SEQ ID NO: 9706 - DNA, 24 bp, Homo sapiens
acagactacctggtgaaggcagca

SEQ ID NO: 9707 - DNA, 24 bp, Homo sapiens
tctccctgcagctcgcactgcctc

SEQ ID NO: 9708 - DNA, 24 bp, Homo sapiens
ctctccctgcagctcgcactgcct

SEQ ID NO: 9709 - DNA, 24 bp, Homo sapiens
actctccctgcagctcgcactgcc

SEQ ID NO: 9710 - DNA, 25 bp, Homo sapiens
acctaaccaatctcaaccagccact

SEQ ID NO: 9711 - DNA, 25 bp, Homo sapiens
acatccaattccagcatcactgtgg

SEQ ID NO: 9712 - DNA, 25 bp, Homo sapiens
cccagcatactttatcgccttcact

SEQ ID NO: 9713 - DNA, 23 bp, Homo sapiens
taagagcccagactgccagcgat

SEQ ID NO: 9714 - DNA, 25 bp, Homo sapiens
cccagcatactttatcgccttcact

SEQ ID NO: 9715 - DNA, 25 bp, Homo sapiens
acatccaattccagcatcactgtgg

SEQ ID NO: 9716 - DNA, 24 bp, Homo sapiens
aattgtccatcatgtcctcgcatt

SEQ ID NO: 9717 - DNA, 24 bp, Homo sapiens
gctgaaactgcaactgacctggtg

SEQ ID NO: 9718 - DNA, 25 bp, Homo sapiens
tgtgagattgtggtggattgtggac

SEQ ID NO: 9719 - DNA, 25 bp, Homo sapiens
agactgctgatggaattagaagaag

SEQ ID NO: 9720 - DNA, 25 bp, Homo sapiens
tgtgagattgtggtggattgtggac

SEQ ID NO: 9721 - DNA, 24 bp, Homo sapiens
aattgtccatcatgtcctcgcatt

SEQ ID NO: 9722 - DNA, 25 bp, Homo sapiens
aggaaagccaaatgggaaagtctgc

SEQ ID NO: 9723 - DNA, 25 bp, Homo sapiens
acatccaattccagcatcactgtgg

SEQ ID NO: 9724 - DNA, 25 bp, Homo sapiens
cccagcatactttatcgccttcact

SEQ ID NO: 9725 - DNA, 25 bp, Homo sapiens
ctatacatccaattccagcatcact

SEQ ID NO: 9726 - DNA, 25 bp, Homo sapiens
cccagcatactttatcgccttcact

SEQ ID NO: 9727 - DNA, 23 bp, Homo sapiens
cgatgctggcgtgggagtcagat

SEQ ID NO: 9728 - DNA, 24 bp, Homo sapiens
gagacggcgagaactatgttgtgc

SEQ ID NO: 9729 - DNA, 24 bp, Homo sapiens
agagacggcgagaactatgttgtg

SEQ ID NO: 9730 - DNA, 24 bp, Homo sapiens
cagagacggcgagaactatgttgt

SEQ ID NO: 9731 - DNA, 23 bp, Homo sapiens
ggattacaagtgtgagccaccgc

SEQ ID NO: 9732 - DNA, 24 bp, Homo sapiens
accttgtgatccacctgcctcaga

SEQ ID NO: 9733 - DNA, 23 bp, Homo sapiens
atcttggccaggctggtcttgaa

SEQ ID NO: 9734 - DNA, 24 bp, Homo sapiens
aaattctgctggtgagagtgtgtg

SEQ ID NO: 9735 - DNA, 24 bp, Homo sapiens
aaaattctgctggtgagagtgtgt

SEQ ID NO: 9736 - DNA, 24 bp, Homo sapiens
caaaattctgctggtgagagtgtg

SEQ ID NO: 9737 - DNA, 25 bp, Homo sapiens
aagaggaggaagataatagttgtgg

SEQ ID NO: 9738 - DNA, 25 bp, Homo sapiens
aaacagcacactttggtgggaacga

SEQ ID NO: 9739 - DNA, 25 bp, Homo sapiens
ttgtattgttcggtctgcttactgg

SEQ ID NO: 9740 - DNA, 24 bp, Homo sapiens
tccaggagcagctcaaagccgtgc

SEQ ID NO: 9741 - DNA, 24 bp, Homo sapiens
ctccaggagcagctcaaagccgtg

SEQ ID NO: 9742 - DNA, 24 bp, Homo sapiens
gctccaggagcagctcaaagccgt

SEQ ID NO: 9743 - DNA, 24 bp, Homo sapiens
agcaatgtgagcaagaaggagcca

SEQ ID NO: 9744 - DNA, 24 bp, Homo sapiens
cagcaatgtgagcaagaaggagcc

SEQ ID NO: 9745 - DNA, 24 bp, Homo sapiens
acagcaatgtgagcaagaaggagc

SEQ ID NO: 9746 - DNA, 23 bp, Homo sapiens
tcaagcatcgactcctccgcaga

SEQ ID NO: 9747 - DNA, 23 bp, Homo sapiens
cctcagccgaatcctcctcctgt

SEQ ID NO: 9748 - DNA, 24 bp, Homo sapiens
tacagagccacccacccatcatcg

SEQ ID NO: 9749 - DNA, 24 bp, Homo sapiens
ccagcaccagagaagagcagcaag

SEQ ID NO: 9750 - DNA, 23 bp, Homo sapiens
caagaagcacgccgcctacgcct

SEQ ID NO: 9751 - DNA, 25 bp, Homo sapiens
acgactactgtgacatcatcaagca

SEQ ID NO: 9752 - DNA, 23 bp, Homo sapiens
ggcttctcgtcctcagagtcgga

SEQ ID NO: 9753 - DNA, 24 bp, Homo sapiens
ctcctctgacagcgaagactccga

SEQ ID NO: 9754 - DNA, 24 bp, Homo sapiens
gcaccatcatcaccaccatcagca

SEQ ID NO: 9755 - DNA, 24 bp, Homo sapiens
ctggcttttagggtcatgcgtctt

SEQ ID NO: 9756 - DNA, 24 bp, Homo sapiens
gctggcttttagggtcatgcgtct

SEQ ID NO: 9757 - DNA, 24 bp, Homo sapiens
agctggcttttagggtcatgcgtc

SEQ ID NO: 9758 - DNA, 24 bp, Homo sapiens
aacagatccaggagctcaatttgg

SEQ ID NO: 9759 - DNA, 24 bp, Homo sapiens
caacagatccaggagctcaatttg

SEQ ID NO: 9760 - DNA, 24 bp, Homo sapiens
ccaacagatccaggagctcaattt

SEQ ID NO: 9761 - DNA, 24 bp, Homo sapiens
aacaggtccagtttatgctaaagg

SEQ ID NO: 9762 - DNA, 24 bp, Homo sapiens
caacaggtccagtttatgctaaag

SEQ ID NO: 9763 - DNA, 24 bp, Homo sapiens
gcaacaggtccagtttatgctaaa

SEQ ID NO: 9764 - DNA, 24 bp, Homo sapiens
gggcaaaacaattccatgaagctt

SEQ ID NO: 9765 - DNA, 24 bp, Homo sapiens
cgggcaaaacaattccatgaagct

SEQ ID NO: 9766 - DNA, 24 bp, Homo sapiens
gcgggcaaaacaattccatgaagc

SEQ ID NO: 9767 - DNA, 24 bp, Homo sapiens
ttgaattccagaccctaaaaagtc

SEQ ID NO: 9768 - DNA, 24 bp, Homo sapiens
cttgaattccagaccctaaaaagt

SEQ ID NO: 9769 - DNA, 24 bp, Homo sapiens
tcttgaattccagaccctaaaaag

SEQ ID NO: 9770 - DNA, 25 bp, Homo sapiens
gggatatgtcagccaaggagaaact

SEQ ID NO: 9771 - DNA, 23 bp, Homo sapiens
cctgctggagtgatgggaagatg

SEQ ID NO: 9772 - DNA, 23 bp, Homo sapiens
gcactcattcaccgataccgacc

SEQ ID NO: 9773 - DNA, 23 bp, Homo sapiens
tgcagcaggtgaatggacttggc

SEQ ID NO: 9774 - DNA, 25 bp, Homo sapiens
agagtgcaggaaaagactgtgatgt

SEQ ID NO: 9775 - DNA, 25 bp, Homo sapiens
atgacatggaagagatcaatgctcg

SEQ ID NO: 9776 - DNA, 24 bp, Homo sapiens
agggacagccattctcctgacctc

SEQ ID NO: 9777 - DNA, 25 bp, Homo sapiens
cgctgttatgacaaaccctggttgg

SEQ ID NO: 9778 - DNA, 25 bp, Homo sapiens
agcacttaatgaaggtccgcaagca

SEQ ID NO: 9779 - DNA, 25 bp, Homo sapiens
tgttggaggtcctctcaggcatcaa

SEQ ID NO: 9780 - DNA, 25 bp, Homo sapiens
gggatatgtcagccaaggagaaact

SEQ ID NO: 9781 - DNA, 25 bp, Homo sapiens
tgatgccttccctaaagttcctgag

SEQ ID NO: 9782 - DNA, 25 bp, Homo sapiens
ggatcagtgctacggaagtggactc

SEQ ID NO: 9783 - DNA, 24 bp, Homo sapiens
cctaatgatgtggaagaagagtgg

SEQ ID NO: 9784 - DNA, 25 bp, Homo sapiens
gcaaatccaaagtaaccgagagaat

SEQ ID NO: 9785 - DNA, 23 bp, Homo sapiens
gcactcattcaccgataccgacc

SEQ ID NO: 9786 - DNA, 23 bp, Homo sapiens
cctgctggagtgatgggaagatg

SEQ ID NO: 9787 - DNA, 24 bp, Homo sapiens
cctaatgatgtggaagaagagtgg

SEQ ID NO: 9788 - DNA, 24 bp, Homo sapiens
atcatagagatgctggaacgagag

SEQ ID NO: 9789 - DNA, 23 bp, Homo sapiens
cggctgtggagaggctggaattg

SEQ ID NO: 9790 - DNA, 25 bp, Homo sapiens
tgatgccttccctaaagttcctgag

SEQ ID NO: 9791 - DNA, 23 bp, Homo sapiens
gcactcattcaccgataccgacc

SEQ ID NO: 9792 - DNA, 23 bp, Homo sapiens
cctgctggagtgatgggaagatg

SEQ ID NO: 9793 - DNA, 25 bp, Homo sapiens
tctgacggagatccagtgtgacatg

SEQ ID NO: 9794 - DNA, 24 bp, Homo sapiens
tggaggaggttcacaaggaggcaa

SEQ ID NO: 9795 - DNA, 25 bp, Homo sapiens
atgccatgtcatctccaaccaagac

SEQ ID NO: 9796 - DNA, 24 bp, Homo sapiens
tggaggaggttcacaaggaggcaa

SEQ ID NO: 9797 - DNA, 25 bp, Homo sapiens
atgccatgtcatctccaaccaagac

SEQ ID NO: 9798 - DNA, 24 bp, Homo sapiens
atgaacgccaggaaagccttcagg

SEQ ID NO: 9799 - DNA, 23 bp, Homo sapiens
actgaggttactgtggctcggca

SEQ ID NO: 9800 - DNA, 25 bp, Homo sapiens
cctggctggattactggtgacatat

SEQ ID NO: 9801 - DNA, 23 bp, Homo sapiens
cctggctgagttggaacagaatt

SEQ ID NO: 9802 - DNA, 23 bp, Homo sapiens
gctggttggcagataccgaggag

SEQ ID NO: 9803 - DNA, 25 bp, Homo sapiens
acctccatctgctgagtataaagtg

SEQ ID NO: 9804 - DNA, 25 bp, Homo sapiens
gaagtttcaagatgccttggagcca

SEQ ID NO: 9805 - DNA, 23 bp, Homo sapiens
ctggctggctgaggttgaggaca

SEQ ID NO: 9806 - DNA, 23 bp, Homo sapiens
gctctgtctaatgctaggctgtt

SEQ ID NO: 9807 - DNA, 23 bp, Homo sapiens
atcattcggcacaaggctctgga

SEQ ID NO: 9808 - DNA, 25 bp, Homo sapiens
gatggtctgcatgaagagctggagt

SEQ ID NO: 9809 - DNA, 25 bp, Homo sapiens
tgagaagcctgaagtgaggaagagc

SEQ ID NO: 9810 - DNA, 25 bp, Homo sapiens
gcagtatcaggacactcttcaggct

SEQ ID NO: 9811 - DNA, 25 bp, Homo sapiens
cctgttggcactgacctcaatactg

SEQ ID NO: 9812 - DNA, 25 bp, Homo sapiens
gctactgatgagacggacagagaca

SEQ ID NO: 9813 - DNA, 24 bp, Homo sapiens
agttggctgactcataccgaagag

SEQ ID NO: 9814 - DNA, 24 bp, Homo sapiens
cttctccaccaagcctgattctaa

SEQ ID NO: 9815 - DNA, 25 bp, Homo sapiens
tcatcgagaccagatcattgagctg

SEQ ID NO: 9816 - DNA, 25 bp, Homo sapiens
agaaggttgtccagcgatctattga

SEQ ID NO: 9817 - DNA, 25 bp, Homo sapiens
agaaggttgtccagcgatctattga

SEQ ID NO: 9818 - DNA, 24 bp, Homo sapiens
tcactagatgatgccaggaagcgg

SEQ ID NO: 9819 - DNA, 25 bp, Homo sapiens
aactgattgactggctagaagatgc

SEQ ID NO: 9820 - DNA, 23 bp, Homo sapiens
ccgcagaacattgaccgagttaa

SEQ ID NO: 9821 - DNA, 23 bp, Homo sapiens
gtcagaactggtggctaatgctg

SEQ ID NO: 9822 - DNA, 23 bp, Homo sapiens
cagcaccagcagcgtcttgaaac

SEQ ID NO: 9823 - DNA, 23 bp, Homo sapiens
agtcggacatcccttgctggtga

SEQ ID NO: 9824 - DNA, 23 bp, Homo sapiens
ttgaaacgaccaacaccaacttt

SEQ ID NO: 9825 - DNA, 23 bp, Homo sapiens
tagttcttccccggcctccacag

SEQ ID NO: 9826 - DNA, 24 bp, Homo sapiens
atcccaacagatgtgaaacccagt

SEQ ID NO: 9827 - DNA, 24 bp, Homo sapiens
tccaaatcacgaaatgcccagaaa

SEQ ID NO: 9828 - DNA, 24 bp, Homo sapiens
ggataacagaccacctgccctagc

SEQ ID NO: 9829 - DNA, 24 bp, Homo sapiens
ctcccaagcaagattcctcttcca

SEQ ID NO: 9830 - DNA, 24 bp, Homo sapiens
tccccctttggaaagtaagcaacg

SEQ ID NO: 9831 - DNA, 24 bp, Homo sapiens
tgacaagtggatccaaatcacgaa

SEQ ID NO: 9832 - DNA, 24 bp, Homo sapiens
gtagtaggcagaccaataggcacc

SEQ ID NO: 9833 - DNA, 24 bp, Homo sapiens
agatcggattggctacttcagtgc

SEQ ID NO: 9834 - DNA, 25 bp, Homo sapiens
cgcaggatgggcttatttgtcagga

SEQ ID NO: 9835 - DNA, 24 bp, Homo sapiens
gacaaggcagggaaacgttttgat

SEQ ID NO: 9836 - DNA, 24 bp, Homo sapiens
agacaaggcagggaaacgttttga

SEQ ID NO: 9837 - DNA, 24 bp, Homo sapiens
cagacaaggcagggaaacgttttg

SEQ ID NO: 9838 - DNA, 24 bp, Homo sapiens
gtatgcgccgagtgagtagcttcc

SEQ ID NO: 9839 - DNA, 24 bp, Homo sapiens
agtatgcgccgagtgagtagcttc

SEQ ID NO: 9840 - DNA, 24 bp, Homo sapiens
cagtatgcgccgagtgagtagctt

SEQ ID NO: 9841 - DNA, 24 bp, Homo sapiens
gagagattcagaacgtggtgtagt

SEQ ID NO: 9842 - DNA, 24 bp, Homo sapiens
tgagagattcagaacgtggtgtag

SEQ ID NO: 9843 - DNA, 24 bp, Homo sapiens
atgagagattcagaacgtggtgta

SEQ ID NO: 9844 - DNA, 25 bp, Homo sapiens
ctagtatctgcacatacctcagcgg

SEQ ID NO: 9845 - DNA, 25 bp, Homo sapiens
gccattcagtgtgttgacaataatc

SEQ ID NO: 9846 - DNA, 24 bp, Homo sapiens
acagaggttccgaagttatgagag

SEQ ID NO: 9847 - DNA, 25 bp, Homo sapiens
cgtccactatgtctttctttcggct

SEQ ID NO: 9848 - DNA, 25 bp, Homo sapiens
atgcccgacagtttgctgaatggat

SEQ ID NO: 9849 - DNA, 24 bp, Homo sapiens
gcttcgagatgcaggtgatttggc

SEQ ID NO: 9850 - DNA, 24 bp, Homo sapiens
ccagaaagggcggaaaggaggaac

SEQ ID NO: 9851 - DNA, 25 bp, Homo sapiens
gccttatttgccacggagacctttg

SEQ ID NO: 9852 - DNA, 25 bp, Homo sapiens
ctgcaatgcaagtgcttcgagatgc

SEQ ID NO: 9853 - DNA, 23 bp, Homo sapiens
ggccaaaggagaccagaaagggc

SEQ ID NO: 9854 - DNA, 23 bp, Homo sapiens
agatgtctggtcgtgctggaagg

SEQ ID NO: 9855 - DNA, 25 bp, Homo sapiens
ggtagatgaaaagatgagcccaaca

SEQ ID NO: 9856 - DNA, 23 bp, Homo sapiens
atggatgatagaggaattgtaat

SEQ ID NO: 9857 - DNA, 24 bp, Homo sapiens
cgcctggaagaattgcttcgacaa

SEQ ID NO: 9858 - DNA, 25 bp, Homo sapiens
agcagcaaaagccattggaaacact

SEQ ID NO: 9859 - DNA, 24 bp, Homo sapiens
acaagaaggagaaatctgcaactc

SEQ ID NO: 9860 - DNA, 24 bp, Homo sapiens
gacaagaaggagaaatctgcaact

SEQ ID NO: 9861 - DNA, 24 bp, Homo sapiens
agacaagaaggagaaatctgcaac

SEQ ID NO: 9862 - DNA, 24 bp, Homo sapiens
cagaggccagcggtcacggagact

SEQ ID NO: 9863 - DNA, 24 bp, Homo sapiens
gcagaggccagcggtcacggagac

SEQ ID NO: 9864 - DNA, 24 bp, Homo sapiens
ggcagaggccagcggtcacggaga

SEQ ID NO: 9865 - DNA, 25 bp, Homo sapiens
atgttgctggagaaggatgtgaacc

SEQ ID NO: 9866 - DNA, 24 bp, Homo sapiens
tggaggagatgatggaagagcagg

SEQ ID NO: 9867 - DNA, 23 bp, Homo sapiens
cctgacatcctggaccacgagcg

SEQ ID NO: 9868 - DNA, 25 bp, Homo sapiens
tctcttcacctgtgcttgatgctgt

SEQ ID NO: 9869 - DNA, 25 bp, Homo sapiens
cctctggacacagcagttctgagtt

SEQ ID NO: 9870 - DNA, 24 bp, Homo sapiens
tccatcaaggagaagcaggtctgg

SEQ ID NO: 9871 - DNA, 24 bp, Homo sapiens
ggtcggtccaggtcttcatctcca

SEQ ID NO: 9872 - DNA, 23 bp, Homo sapiens
aatctagcacaccaccaggcgag

SEQ ID NO: 9873 - DNA, 23 bp, Homo sapiens
ctgagcagagcaggttccagtct

SEQ ID NO: 9874 - DNA, 24 bp, Homo sapiens
cagtcttcttcctcagagagcagc

SEQ ID NO: 9875 - DNA, 24 bp, Homo sapiens
ccagtcttcttcctcagagagcag

SEQ ID NO: 9876 - DNA, 24 bp, Homo sapiens
cccagtcttcttcctcagagagca

SEQ ID NO: 9877 - DNA, 24 bp, Homo sapiens
ggaccgttcaccacctaagtctcc

SEQ ID NO: 9878 - DNA, 23 bp, Homo sapiens
ttaagccaggagccagtgaaccc

SEQ ID NO: 9879 - DNA, 23 bp, Homo sapiens
ctccttgctgagcgacatggcgg

SEQ ID NO: 9880 - DNA, 23 bp, Homo sapiens
ctctccttcgccaaagcctcgtg

SEQ ID NO: 9881 - DNA, 23 bp, Homo sapiens
agaggtcccgttcccgctcaagg

SEQ ID NO: 9882 - DNA, 23 bp, Homo sapiens
tcaacctctcggcgaagacagcg

SEQ ID NO: 9883 - DNA, 25 bp, Homo sapiens
tggaggtggtagagaagtctgaaga

SEQ ID NO: 9884 - DNA, 25 bp, Homo sapiens
aagagaaagaagtggtgctgggtca

SEQ ID NO: 9885 - DNA, 25 bp, Homo sapiens
gcattgcctacgtcaagccaagatg

SEQ ID NO: 9886 - DNA, 24 bp, Homo sapiens
cagaacgccaccagtaacccgccg

SEQ ID NO: 9887 - DNA, 24 bp, Homo sapiens
ccagaacgccaccagtaacccgcc

SEQ ID NO: 9888 - DNA, 24 bp, Homo sapiens
tccagaacgccaccagtaacccgc

SEQ ID NO: 9889 - DNA, 24 bp, Homo sapiens
gcagaacttcgcctatcactcgca

SEQ ID NO: 9890 - DNA, 24 bp, Homo sapiens
atctcgcacatctccagtaactcg

SEQ ID NO: 9891 - DNA, 23 bp, Homo sapiens
ccagtgacacgccgccgctctag

SEQ ID NO: 9892 - DNA, 24 bp, Homo sapiens
atctcgagcctctccagccactca

SEQ ID NO: 9893 - DNA, 24 bp, Homo sapiens
gatctcgagcctctccagccactc

SEQ ID NO: 9894 - DNA, 24 bp, Homo sapiens
agatctcgagcctctccagccact

SEQ ID NO: 9895 - DNA, 24 bp, Homo sapiens
atctcgcacatctccagtaactcg

SEQ ID NO: 9896 - DNA, 24 bp, Homo sapiens
gcagaacttcgcctatcactcgca

SEQ ID NO: 9897 - DNA, 24 bp, Homo sapiens
tccaggactccaccagtaaccagg

SEQ ID NO: 9898 - DNA, 25 bp, Homo sapiens
gaagaatgaaagactccgtgctgcc

SEQ ID NO: 9899 - DNA, 23 bp, Homo sapiens
tttgatcctcagcgtcgtgcccg

SEQ ID NO: 9900 - DNA, 23 bp, Homo sapiens
atcagtgattcttacgtagatgg

SEQ ID NO: 9901 - DNA, 23 bp, Homo sapiens
gctgactctgcttcctcctccga

SEQ ID NO: 9902 - DNA, 24 bp, Homo sapiens
aactcatacaactgccttggctgg

SEQ ID NO: 9903 - DNA, 23 bp, Homo sapiens
ctccttgctgagcgacatggcgg

SEQ ID NO: 9904 - DNA, 24 bp, Homo sapiens
aactcatacaactgccttggctgg

SEQ ID NO: 9905 - DNA, 23 bp, Homo sapiens
ctccttgctgagcgacatggcgg

SEQ ID NO: 9906 - DNA, 23 bp, Homo sapiens
ttaagccaggagccagtgaaccc

SEQ ID NO: 9907 - DNA, 24 bp, Homo sapiens
ggcgagcggagcagcagcagtgag

SEQ ID NO: 9908 - DNA, 24 bp, Homo sapiens
tggcgagcggagcagcagcagtga

SEQ ID NO: 9909 - DNA, 24 bp, Homo sapiens
ctggcgagcggagcagcagcagtg

SEQ ID NO: 9910 - DNA, 24 bp, Homo sapiens
ccaggacaaagacaggagaaggag

SEQ ID NO: 9911 - DNA, 24 bp, Homo sapiens
accaggacaaagacaggagaagga

SEQ ID NO: 9912 - DNA, 24 bp, Homo sapiens
aaccaggacaaagacaggagaagg

SEQ ID NO: 9913 - DNA, 25 bp, Homo sapiens
tctgtttagtgaacttggaccctac

SEQ ID NO: 9914 - DNA, 24 bp, Homo sapiens
gttggatcgactggttgtggatgc

SEQ ID NO: 9915 - DNA, 24 bp, Homo sapiens
tcaaacgagccagcaatgccttca

SEQ ID NO: 9916 - DNA, 24 bp, Homo sapiens
aacgaggtgccaatcaacatgcca

SEQ ID NO: 9917 - DNA, 25 bp, Homo sapiens
gccaatgctgatatagtcaccttgt

SEQ ID NO: 9918 - DNA, 25 bp, Homo sapiens
aagagatgcgggaatcagaaggact

SEQ ID NO: 9919 - DNA, 24 bp, Homo sapiens
aacgaggtgccaatcaacatgcca

SEQ ID NO: 9920 - DNA, 25 bp, Homo sapiens
accctttgagcatagctgtggaagc

SEQ ID NO: 9921 - DNA, 24 bp, Homo sapiens
agccccatgaggttagcaccattg

SEQ ID NO: 9922 - DNA, 24 bp, Homo sapiens
gagccccatgaggttagcaccatt

SEQ ID NO: 9923 - DNA, 24 bp, Homo sapiens
agagccccatgaggttagcaccat

SEQ ID NO: 9924 - DNA, 24 bp, Homo sapiens
cttcttgccaggcggctggagaac

SEQ ID NO: 9925 - DNA, 24 bp, Homo sapiens
tcttcttgccaggcggctggagaa

SEQ ID NO: 9926 - DNA, 24 bp, Homo sapiens
ttcttcttgccaggcggctggaga

SEQ ID NO: 9927 - DNA, 24 bp, Homo sapiens
gccggtgcaaggagacatcctcaa

SEQ ID NO: 9928 - DNA, 24 bp, Homo sapiens
agccggtgcaaggagacatcctca

SEQ ID NO: 9929 - DNA, 24 bp, Homo sapiens
aagccggtgcaaggagacatcctc

SEQ ID NO: 9930 - DNA, 24 bp, Homo sapiens
cctgagcagcctttggatgttact

SEQ ID NO: 9931 - DNA, 25 bp, Homo sapiens
ccacagggaacaacaaagaaaacaa

SEQ ID NO: 9932 - DNA, 24 bp, Homo sapiens
tgtgtcctcaggtggcagtttatg

SEQ ID NO: 9933 - DNA, 24 bp, Homo sapiens
ctgtgtcctcaggtggcagtttat

SEQ ID NO: 9934 - DNA, 24 bp, Homo sapiens
gctgtgtcctcaggtggcagttta

SEQ ID NO: 9935 - DNA, 23 bp, Homo sapiens
ctattctcctgtctcagcctcct

SEQ ID NO: 9936 - DNA, 23 bp, Homo sapiens
ctgactgcaacctccacctccca

SEQ ID NO: 9937 - DNA, 23 bp, Homo sapiens
cgggctggagtgcaatggcatga

SEQ ID NO: 9938 - DNA, 24 bp, Homo sapiens
gcccccacctgagttctatccagg

SEQ ID NO: 9939 - DNA, 24 bp, Homo sapiens
cgcccccacctgagttctatccag

SEQ ID NO: 9940 - DNA, 24 bp, Homo sapiens
ccgcccccacctgagttctatcca

SEQ ID NO: 9941 - DNA, 24 bp, Homo sapiens
cactcctgcagccgaagccaaggc

SEQ ID NO: 9942 - DNA, 24 bp, Homo sapiens
ccactcctgcagccgaagccaagg

SEQ ID NO: 9943 - DNA, 24 bp, Homo sapiens
tccactcctgcagccgaagccaag

SEQ ID NO: 9944 - DNA, 24 bp, Homo sapiens
acatgcccacgagccagccgccgc

SEQ ID NO: 9945 - DNA, 24 bp, Homo sapiens
tacatgcccacgagccagccgccg

SEQ ID NO: 9946 - DNA, 24 bp, Homo sapiens
ctacatgcccacgagccagccgcc

SEQ ID NO: 9947 - DNA, 23 bp, Homo sapiens
ccgccacctccctactacccacc

SEQ ID NO: 9948 - DNA, 23 bp, Homo sapiens
ccgccagtcgccaatggaatgta

SEQ ID NO: 9949 - DNA, 25 bp, Homo sapiens
tctcaagcctccagaggtgaagtcc

SEQ ID NO: 9950 - DNA, 25 bp, Homo sapiens
tgagatcaagcagcccgtatttggt

SEQ ID NO: 9951 - DNA, 24 bp, Homo sapiens
cgggtcatctttctgtccaagggc

SEQ ID NO: 9952 - DNA, 25 bp, Homo sapiens
tcaaagggaccaagaaaggcactgt

SEQ ID NO: 9953 - DNA, 23 bp, Homo sapiens
ccgccagtcgccaatggaatgta

SEQ ID NO: 9954 - DNA, 23 bp, Homo sapiens
gctactcttacatgcccagcggg

SEQ ID NO: 9955 - DNA, 23 bp, Homo sapiens
ctcctggctacccctatccaccg

SEQ ID NO: 9956 - DNA, 25 bp, Homo sapiens
tgagatcaagcagcccgtatttggt

SEQ ID NO: 9957 - DNA, 23 bp, Homo sapiens
aagggaacagtgaaggcggaagc

SEQ ID NO: 9958 - DNA, 24 bp, Homo sapiens
ggctctgcttcctacaagttgact

SEQ ID NO: 9959 - DNA, 24 bp, Homo sapiens
acaacccaggcaatcctcacaacg

SEQ ID NO: 9960 - DNA, 23 bp, Homo sapiens
ccgccacctccctactacccacc

SEQ ID NO: 9961 - DNA, 25 bp, Homo sapiens
ctgcctcccaccctcatctctctac

SEQ ID NO: 9962 - DNA, 23 bp, Homo sapiens
gaagtgggcggtgggtggtgggt

SEQ ID NO: 9963 - DNA, 25 bp, Homo sapiens
cctattacaacccaggcaatcctca

SEQ ID NO: 9964 - DNA, 24 bp, Homo sapiens
ttgccatcccgtggagcacatgat

SEQ ID NO: 9965 - DNA, 24 bp, Homo sapiens
tttgccatcccgtggagcacatga

SEQ ID NO: 9966 - DNA, 24 bp, Homo sapiens
ctttgccatcccgtggagcacatg

SEQ ID NO: 9967 - DNA, 24 bp, Homo sapiens
aaagtgctgggattataggcatga

SEQ ID NO: 9968 - DNA, 24 bp, Homo sapiens
caaagtgctgggattataggcatg

SEQ ID NO: 9969 - DNA, 24 bp, Homo sapiens
ccaaagtgctgggattataggcat

SEQ ID NO: 9970 - DNA, 23 bp, Homo sapiens
caggctggtcttgaactcttggc

SEQ ID NO: 9971 - DNA, 23 bp, Homo sapiens
tggtccacctgcctcagcctccc

SEQ ID NO: 9972 - DNA, 25 bp, Homo sapiens
cactgcccacgaggacttcacattt

SEQ ID NO: 9973 - DNA, 23 bp, Homo sapiens
cccagcctgacctccgacgaatc

SEQ ID NO: 9974 - DNA, 24 bp, Homo sapiens
ccaagttgatgacacctgacgcct

SEQ ID NO: 9975 - DNA, 24 bp, Homo sapiens
ccaagttgatgacacctgacgcct

SEQ ID NO: 9976 - DNA, 25 bp, Homo sapiens
cactgcccacgaggacttcacattt

SEQ ID NO: 9977 - DNA, 23 bp, Homo sapiens
ctgaggtgctgcctgccgaagag

SEQ ID NO: 9978 - DNA, 24 bp, Homo sapiens
aatctcggctcactacacctctgc

SEQ ID NO: 9979 - DNA, 24 bp, Homo sapiens
gctcaagcacttctcctgcctcag

SEQ ID NO: 9980 - DNA, 23 bp, Homo sapiens
actagatggtgcctcgctcgtgc

SEQ ID NO: 9981 - DNA, 23 bp, Homo sapiens
aaggagaggacagtgaggaagat

SEQ ID NO: 9982 - DNA, 24 bp, Homo sapiens
accgagtactttgatgccatggaa

SEQ ID NO: 9983 - DNA, 23 bp, Homo sapiens
acatccttcatcaccgtgatcac

SEQ ID NO: 9984 - DNA, 24 bp, Homo sapiens
agaagcatcgagagaaggaactga

SEQ ID NO: 9985 - DNA, 24 bp, Homo sapiens
tgccaggagacaatgctttggaca

SEQ ID NO: 9986 - DNA, 24 bp, Homo sapiens
gaggacatcctgagcctgcccgag

SEQ ID NO: 9987 - DNA, 25 bp, Homo sapiens
ccagtcagccactaagcagttggat

SEQ ID NO: 9988 - DNA, 25 bp, Homo sapiens
tcgttctcaaactcctcctccaaca

SEQ ID NO: 9989 - DNA, 23 bp, Homo sapiens
tacggcaagaggcagaagaggca

SEQ ID NO: 9990 - DNA, 24 bp, Homo sapiens
gccccctccagcctgtagcagcca

SEQ ID NO: 9991 - DNA, 24 bp, Homo sapiens
tgccccctccagcctgtagcagcc

SEQ ID NO: 9992 - DNA, 24 bp, Homo sapiens
gtgccccctccagcctgtagcagc

SEQ ID NO: 9993 - DNA, 24 bp, Homo sapiens
agctgcctcagctcacatccttag

SEQ ID NO: 9994 - DNA, 24 bp, Homo sapiens
cagctgcctcagctcacatcctta

SEQ ID NO: 9995 - DNA, 24 bp, Homo sapiens
gcagctgcctcagctcacatcctt

SEQ ID NO: 9996 - DNA, 24 bp, Homo sapiens
ttgtgtcctgctggtctgaactga

SEQ ID NO: 9997 - DNA, 24 bp, Homo sapiens
cctcacctcacaagacatcgctga

SEQ ID NO: 9998 - DNA, 24 bp, Homo sapiens
acagaccctcttaaacttggctga

SEQ ID NO: 9999 - DNA, 24 bp, Homo sapiens
aggagctggaggtggccgaccaga

SEQ ID NO: 10000 - DNA, 24 bp, Homo sapiens
aaggagctggaggtggccgaccag

SEQ ID NO: 10001 - DNA, 24 bp, Homo sapiens
caaggagctggaggtggccgacca

SEQ ID NO: 10002 - DNA, 24 bp, Homo sapiens
caggtgatccaccttcctcggcct

SEQ ID NO: 10003 - DNA, 24 bp, Homo sapiens
tcaggtgatccaccttcctcggcc

SEQ ID NO: 10004 - DNA, 24 bp, Homo sapiens
ctcaggtgatccaccttcctcggc

SEQ ID NO: 10005 - DNA, 24 bp, Homo sapiens
atcatgggcaggtaggttactcta

SEQ ID NO: 10006 - DNA, 24 bp, Homo sapiens
gatcatgggcaggtaggttactct

SEQ ID NO: 10007 - DNA, 24 bp, Homo sapiens
cgatcatgggcaggtaggttactc

SEQ ID NO: 10008 - DNA, 24 bp, Homo sapiens
gtgaagacaaggccaatcttcatg

SEQ ID NO: 10009 - DNA, 24 bp, Homo sapiens
tgtgaagacaaggccaatcttcat

SEQ ID NO: 10010 - DNA, 24 bp, Homo sapiens
atgtgaagacaaggccaatcttca

SEQ ID NO: 10011 - DNA, 24 bp, Homo sapiens
agtggcacagggtaacttcttatt

SEQ ID NO: 10012 - DNA, 24 bp, Homo sapiens
aagtggcacagggtaacttcttat

SEQ ID NO: 10013 - DNA, 24 bp, Homo sapiens
aaagtggcacagggtaacttctta

SEQ ID NO: 10014 - DNA, 24 bp, Homo sapiens
acaccaagcaggttcatgaaagcc

SEQ ID NO: 10015 - DNA, 24 bp, Homo sapiens
aacaccaagcaggttcatgaaagc

SEQ ID NO: 10016 - DNA, 24 bp, Homo sapiens
taacaccaagcaggttcatgaaag

SEQ ID NO: 10017 - DNA, 25 bp, Homo sapiens
gccatcatttacactgcttgccaac

SEQ ID NO: 10018 - DNA, 23 bp, Homo sapiens
gcgagccagtgcagccttgaact

SEQ ID NO: 10019 - DNA, 25 bp, Homo sapiens
aacgaggacctaagccttatagtct

SEQ ID NO: 10020 - DNA, 25 bp, Homo sapiens
gcaacacaccagaaacgggatcagt

SEQ ID NO: 10021 - DNA, 25 bp, Homo sapiens
accttagagatagccaagtccttca

SEQ ID NO: 10022 - DNA, 24 bp, Homo sapiens
gctcacggttgtaggttgccagtt

SEQ ID NO: 10023 - DNA, 25 bp, Homo sapiens
gcaacacaccagaaacgggatcagt

SEQ ID NO: 10024 - DNA, 25 bp, Homo sapiens
aacgaggacctaagccttatagtct

SEQ ID NO: 10025 - DNA, 25 bp, Homo sapiens
gccatcatttacactgcttgccaac

SEQ ID NO: 10026 - DNA, 25 bp, Homo sapiens
tgattacattggtcttgctctcccg

SEQ ID NO: 10027 - DNA, 24 bp, Homo sapiens
caacgatcttcctcagtgcggtcc

SEQ ID NO: 10028 - DNA, 25 bp, Homo sapiens
tgagtccagattaacaccaagcagg

SEQ ID NO: 10029 - DNA, 23 bp, Homo sapiens
atgatacaccaatgtgccgtata

SEQ ID NO: 10030 - DNA, 25 bp, Homo sapiens
cgcaaagaagttctaagattagtca

SEQ ID NO: 10031 - DNA, 25 bp, Homo sapiens
gtagttcagtttcaactaaatgtca

SEQ ID NO: 10032 - DNA, 25 bp, Homo sapiens
tccagatgatacaccaatgtgccgt

SEQ ID NO: 10033 - DNA, 25 bp, Homo sapiens
ggtgtgagcagactatccataatcc

SEQ ID NO: 10034 - DNA, 24 bp, Homo sapiens
tttccagcccagcaaccaactgag

SEQ ID NO: 10035 - DNA, 24 bp, Homo sapiens
gaaggttcatcgtaagagtcaacc

SEQ ID NO: 10036 - DNA, 24 bp, Homo sapiens
tgaaggttcatcgtaagagtcaac

SEQ ID NO: 10037 - DNA, 24 bp, Homo sapiens
atgaaggttcatcgtaagagtcaa

SEQ ID NO: 10038 - DNA, 24 bp, Homo sapiens
ctagcggacaatgatggagagatc

SEQ ID NO: 10039 - DNA, 24 bp, Homo sapiens
cctagcggacaatgatggagagat

SEQ ID NO: 10040 - DNA, 24 bp, Homo sapiens
acctagcggacaatgatggagaga

SEQ ID NO: 10041 - DNA, 24 bp, Homo sapiens
atctagatgaggaacaagacagtg

SEQ ID NO: 10042 - DNA, 24 bp, Homo sapiens
aatctagatgaggaacaagacagt

SEQ ID NO: 10043 - DNA, 24 bp, Homo sapiens
aaatctagatgaggaacaagacag

SEQ ID NO: 10044 - DNA, 24 bp, Homo sapiens
ttcttttctagccacagtcagagt

SEQ ID NO: 10045 - DNA, 24 bp, Homo sapiens
tttcttttctagccacagtcagag

SEQ ID NO: 10046 - DNA, 24 bp, Homo sapiens
gtttcttttctagccacagtcaga

SEQ ID NO: 10047 - DNA, 24 bp, Homo sapiens
acgatgatgtggatacctctgatt

SEQ ID NO: 10048 - DNA, 25 bp, Homo sapiens
atcagcagagatgagtcaaggaact

SEQ ID NO: 10049 - DNA, 25 bp, Homo sapiens
ccttcggagttacctagcggacaat

SEQ ID NO: 10050 - DNA, 24 bp, Homo sapiens
gcaggccaaagattcggaacacca

SEQ ID NO: 10051 - DNA, 24 bp, Homo sapiens
agcaggccaaagattcggaacacc

SEQ ID NO: 10052 - DNA, 24 bp, Homo sapiens
gagcaggccaaagattcggaacac

SEQ ID NO: 10053 - DNA, 24 bp, Homo sapiens
acgagaggaggaacaggagtgaca

SEQ ID NO: 10054 - DNA, 25 bp, Homo sapiens
ttggaggtgtgaactcttcgtctca

SEQ ID NO: 10055 - DNA, 24 bp, Homo sapiens
actacaacaacttccacgcagccg

SEQ ID NO: 10056 - DNA, 25 bp, Homo sapiens
agaccagtcctgcctctgttgtaga

SEQ ID NO: 10057 - DNA, 24 bp, Homo sapiens
actacaacaacttccacgcagccg

SEQ ID NO: 10058 - DNA, 25 bp, Homo sapiens
ttggaggtgtgaactcttcgtctca

SEQ ID NO: 10059 - DNA, 25 bp, Homo sapiens
gtctgaggagcccatctacatcgtc

SEQ ID NO: 10060 - DNA, 25 bp, Homo sapiens
actcttaaaccaggcacaatgtccc

SEQ ID NO: 10061 - DNA, 23 bp, Homo sapiens
ctgaagcacgacaagctggtcca

SEQ ID NO: 10062 - DNA, 25 bp, Homo sapiens
gtctgaggagcccatctacatcgtc

SEQ ID NO: 10063 - DNA, 25 bp, Homo sapiens
catgaagaagctgaagcacgacaag

SEQ ID NO: 10064 - DNA, 25 bp, Homo sapiens
actcttaaaccaggcacaatgtccc

SEQ ID NO: 10065 - DNA, 25 bp, Homo sapiens
agaaggttgagagtgccaaggagtc

SEQ ID NO: 10066 - DNA, 25 bp, Homo sapiens
agaagagaaggaggcacaacttgga

SEQ ID NO: 10067 - DNA, 23 bp, Homo sapiens
gaggcaccacctttgctgttcag

SEQ ID NO: 10068 - DNA, 25 bp, Homo sapiens
tgaggaagaggatgatgatggctgt

SEQ ID NO: 10069 - DNA, 25 bp, Homo sapiens
ttgctgactctgagaaggaggagga

SEQ ID NO: 10070 - DNA, 23 bp, Homo sapiens
gagtggacgaggagccgacaacc

SEQ ID NO: 10071 - DNA, 25 bp, Homo sapiens
tgatgatggtgatgatgatgacgac

SEQ ID NO: 10072 - DNA, 23 bp, Homo sapiens
tgctgcctccgttccatcactga

SEQ ID NO: 10073 - DNA, 25 bp, Homo sapiens
gatgatgaggacgaggagagtgacc

SEQ ID NO: 10074 - DNA, 24 bp, Homo sapiens
ctccgccttccaggttcaagcaat

SEQ ID NO: 10075 - DNA, 23 bp, Homo sapiens
gcagtggcacgatctcggttcac

SEQ ID NO: 10076 - DNA, 25 bp, Homo sapiens
tgtatgccaccacacctgtctaatt

SEQ ID NO: 10077 - DNA, 25 bp, Homo sapiens
caacttctgcctcccaggttcaagg

SEQ ID NO: 10078 - DNA, 24 bp, Homo sapiens
ctcctcagcctcctgagtagctgg

SEQ ID NO: 10079 - DNA, 24 bp, Homo sapiens
cccgcctcggcctcctgagtagct

SEQ ID NO: 10080 - DNA, 24 bp, Homo sapiens
acccgcctcggcctcctgagtagc

SEQ ID NO: 10081 - DNA, 24 bp, Homo sapiens
tacccgcctcggcctcctgagtag

SEQ ID NO: 10082 - DNA, 24 bp, Homo sapiens
aggacaagcaggagcctgctgcag

SEQ ID NO: 10083 - DNA, 24 bp, Homo sapiens
caggacaagcaggagcctgctgca

SEQ ID NO: 10084 - DNA, 24 bp, Homo sapiens
tcaggacaagcaggagcctgctgc

SEQ ID NO: 10085 - DNA, 24 bp, Homo sapiens
tctctccacagtccgaatctgctc

SEQ ID NO: 10086 - DNA, 24 bp, Homo sapiens
atctctccacagtccgaatctgct

SEQ ID NO: 10087 - DNA, 24 bp, Homo sapiens
tatctctccacagtccgaatctgc

SEQ ID NO: 10088 - DNA, 24 bp, Homo sapiens
ggctgaggcaggagaattacttga

SEQ ID NO: 10089 - DNA, 24 bp, Homo sapiens
aggctgaggcaggagaattacttg

SEQ ID NO: 10090 - DNA, 24 bp, Homo sapiens
gaggctgaggcaggagaattactt

SEQ ID NO: 10091 - DNA, 25 bp, Homo sapiens
tctggttcaagtgagtctcctgcct

SEQ ID NO: 10092 - DNA, 23 bp, Homo sapiens
atgagccactatgcccagccaca

SEQ ID NO: 10093 - DNA, 23 bp, Homo sapiens
aggctagagtgcagtggcgtgag

SEQ ID NO: 10094 - DNA, 25 bp, Homo sapiens
ctttgtgggagttcttctatgggca

SEQ ID NO: 10095 - DNA, 25 bp, Homo sapiens
acgacagatgactgggaagtgtgaa

SEQ ID NO: 10096 - DNA, 25 bp, Homo sapiens
gcacaaaggacacacaggatagaaa

SEQ ID NO: 10097 - DNA, 24 bp, Homo sapiens
ttttttggcagtgcacagccagag

SEQ ID NO: 10098 - DNA, 24 bp, Homo sapiens
cttttttggcagtgcacagccaga

SEQ ID NO: 10099 - DNA, 24 bp, Homo sapiens
tcttttttggcagtgcacagccag

SEQ ID NO: 10100 - DNA, 24 bp, Homo sapiens
gcggacacagcctcaagtttggaa

SEQ ID NO: 10101 - DNA, 24 bp, Homo sapiens
atacgggaggtctctgcgatatga

SEQ ID NO: 10102 - DNA, 24 bp, Homo sapiens
ggtccatccatcgcataagagcaa

SEQ ID NO: 10103 - DNA, 24 bp, Homo sapiens
ggagacctgaagcatctgaagacg

SEQ ID NO: 10104 - DNA, 24 bp, Homo sapiens
gtctggaacacggacctggtggag

SEQ ID NO: 10105 - DNA, 24 bp, Homo sapiens
cagaccgtcaatggagcagaggcg

SEQ ID NO: 10106 - DNA, 24 bp, Homo sapiens
ccgtcagagcattactgtgtgagc

SEQ ID NO: 10107 - DNA, 24 bp, Homo sapiens
ccctgtcagagcattactgtgagc

SEQ ID NO: 10108 - DNA, 24 bp, Homo sapiens
ccctgtcagagcattactgtgtga

SEQ ID NO: 10109 - DNA, 24 bp, Homo sapiens
aaacagttgtgctcatgtgatggg

SEQ ID NO: 10110 - DNA, 24 bp, Homo sapiens
ctaggaaggagtggactgttggcg

SEQ ID NO: 10111 - DNA, 24 bp, Homo sapiens
gcgtaagagaagccaaataaagcg

SEQ ID NO: 10112 - DNA, 24 bp, Homo sapiens
ccgtcagagcattactgtgtgagc

SEQ ID NO: 10113 - DNA, 24 bp, Homo sapiens
ccctgtcagagcattactgtgtga

SEQ ID NO: 10114 - DNA, 24 bp, Homo sapiens
ccctgtcagagcattactgtgtga

SEQ ID NO: 10115 - DNA, 24 bp, Homo sapiens
cagaccgtcaatggagcagaggcg

SEQ ID NO: 10116 - DNA, 24 bp, Homo sapiens
ttgaggagcactggaggaagcaca

SEQ ID NO: 10117 - DNA, 24 bp, Homo sapiens
tgagacaagatgcggtgatgacag

SEQ ID NO: 10118 - DNA, 24 bp, Homo sapiens
ttgaggagcactggaggaagcaca

SEQ ID NO: 10119 - DNA, 24 bp, Homo sapiens
gatcactccaagcccatccagggg

SEQ ID NO: 10120 - DNA, 23 bp, Homo sapiens
caggctggagtacagtggcacca

SEQ ID NO: 10121 - DNA, 23 bp, Homo sapiens
ctcactgcaacttccgcctcctg

SEQ ID NO: 10122 - DNA, 24 bp, Homo sapiens
aacgattcttctgcctcagcatcc

SEQ ID NO: 10123 - DNA, 24 bp, Homo sapiens
cctcctgcctggcacccacacgct

SEQ ID NO: 10124 - DNA, 24 bp, Homo sapiens
tcctcctgcctggcacccacacgc

SEQ ID NO: 10125 - DNA, 24 bp, Homo sapiens
ttcctcctgcctggcacccacacg

SEQ ID NO: 10126 - DNA, 25 bp, Homo sapiens
catggctcctgttcatctgcccttg

SEQ ID NO: 10127 - DNA, 24 bp, Homo sapiens
cagaagcttcggcaggaatttgag

SEQ ID NO: 10128 - DNA, 24 bp, Homo sapiens
ccagaagcttcggcaggaatttga

SEQ ID NO: 10129 - DNA, 24 bp, Homo sapiens
tccagaagcttcggcaggaatttg

SEQ ID NO: 10130 - DNA, 25 bp, Homo sapiens
aggagtgggagacgagactgaatgg

SEQ ID NO: 10131 - DNA, 25 bp, Homo sapiens
cagttagtgaggaacggagccaagc

SEQ ID NO: 10132 - DNA, 25 bp, Homo sapiens
ccctactcccactttacctccaccc

SEQ ID NO: 10133 - DNA, 23 bp, Homo sapiens
ccagttagtgaggaacggagcca

SEQ ID NO: 10134 - DNA, 25 bp, Homo sapiens
gcagccttcctcaaatccctactcc

SEQ ID NO: 10135 - DNA, 25 bp, Homo sapiens
ccatcagagacagacttcatgcttc

SEQ ID NO: 10136 - DNA, 24 bp, Homo sapiens
agactcaagaatcaggatggcgaa

SEQ ID NO: 10137 - DNA, 25 bp, Homo sapiens
aggagtgggagacgagactgaatgg

SEQ ID NO: 10138 - DNA, 25 bp, Homo sapiens
cagttagtgaggaacggagccaagc

SEQ ID NO: 10139 - DNA, 25 bp, Homo sapiens
gccttcctcaaatccctactcccac

SEQ ID NO: 10140 - DNA, 25 bp, Homo sapiens
cagttagtgaggaacggagccaagc

SEQ ID NO: 10141 - DNA, 25 bp, Homo sapiens
aggagtgggagacgagactgaatgg

SEQ ID NO: 10142 - DNA, 25 bp, Homo sapiens
tttcccaatgatgctaactgccctt

SEQ ID NO: 10143 - DNA, 25 bp, Homo sapiens
ggtcaccactaggcactaacatcgc

SEQ ID NO: 10144 - DNA, 25 bp, Homo sapiens
tggagatggtctatctgatgctgaa

SEQ ID NO: 10145 - DNA, 25 bp, Homo sapiens
gccttgggaaagcagcaacattaga

SEQ ID NO: 10146 - DNA, 25 bp, Homo sapiens
ggtcaccactaggcactaacatcgc

SEQ ID NO: 10147 - DNA, 25 bp, Homo sapiens
tttcccaatgatgctaactgccctt

SEQ ID NO: 10148 - DNA, 25 bp, Homo sapiens
tgactgaggaatttcgggaagtagc

SEQ ID NO: 10149 - DNA, 25 bp, Homo sapiens
gcagagtttaatttggatcttggtt

SEQ ID NO: 10150 - DNA, 25 bp, Homo sapiens
ctaggatatgaaaaacacgtcagcc

SEQ ID NO: 10151 - DNA, 24 bp, Homo sapiens
gagttcaagaccagtctggccaac

SEQ ID NO: 10152 - DNA, 24 bp, Homo sapiens
ggagttcaagaccagtctggccaa

SEQ ID NO: 10153 - DNA, 24 bp, Homo sapiens
gggagttcaagaccagtctggcca

SEQ ID NO: 10154 - DNA, 24 bp, Homo sapiens
acaggcatgagccactgtgcctgg

SEQ ID NO: 10155 - DNA, 24 bp, Homo sapiens
tacaggcatgagccactgtgcctg

SEQ ID NO: 10156 - DNA, 24 bp, Homo sapiens
ttacaggcatgagccactgtgcct

SEQ ID NO: 10157 - DNA, 25 bp, Homo sapiens
ccatgctggtcttgaactcctaagc

SEQ ID NO: 10158 - DNA, 23 bp, Homo sapiens
ctgcccacctcgacctcccaaag

SEQ ID NO: 10159 - DNA, 24 bp, Homo sapiens
cagacacccaggtgcagccaaagc

SEQ ID NO: 10160 - DNA, 24 bp, Homo sapiens
acagacacccaggtgcagccaaag

SEQ ID NO: 10161 - DNA, 24 bp, Homo sapiens
cacagacacccaggtgcagccaaa

SEQ ID NO: 10162 - DNA, 24 bp, Homo sapiens
ttgtttgacagcctgggttggtgg

SEQ ID NO: 10163 - DNA, 24 bp, Homo sapiens
tttgtttgacagcctgggttggtg

SEQ ID NO: 10164 - DNA, 24 bp, Homo sapiens
ttttgtttgacagcctgggttggt

SEQ ID NO: 10165 - DNA, 23 bp, Homo sapiens
ggaggcagaggcaggagaatcgt

SEQ ID NO: 10166 - DNA, 23 bp, Homo sapiens
ctgggaagcggaggttgcagtga

SEQ ID NO: 10167 - DNA, 24 bp, Homo sapiens
tcagtctccaggtgattggatgtg

SEQ ID NO: 10168 - DNA, 24 bp, Homo sapiens
ttcagtctccaggtgattggatgt

SEQ ID NO: 10169 - DNA, 24 bp, Homo sapiens
cttcagtctccaggtgattggatg

SEQ ID NO: 10170 - DNA, 24 bp, Homo sapiens
gatgcaacaaggtaagaaagttgt

SEQ ID NO: 10171 - DNA, 24 bp, Homo sapiens
agatgcaacaaggtaagaaagttg

SEQ ID NO: 10172 - DNA, 24 bp, Homo sapiens
cagatgcaacaaggtaagaaagtt

SEQ ID NO: 10173 - DNA, 23 bp, Homo sapiens
ccatccttcaagttacacaacac

SEQ ID NO: 10174 - DNA, 24 bp, Homo sapiens
tagcccagtgcctagtccatacgc

SEQ ID NO: 10175 - DNA, 25 bp, Homo sapiens
gctctgggaacagatttatgccaca

SEQ ID NO: 10176 - DNA, 25 bp, Homo sapiens
gcttaatgaacttggcagtgaatct

SEQ ID NO: 10177 - DNA, 25 bp, Homo sapiens
tggagagaccttattatggagagag

SEQ ID NO: 10178 - DNA, 25 bp, Homo sapiens
atcagcggatgcttgtcttacaact

SEQ ID NO: 10179 - DNA, 25 bp, Homo sapiens
attcgcagagtcaatgatgaagagg

SEQ ID NO: 10180 - DNA, 25 bp, Homo sapiens
agtgtccgagaagcagcagtagaat

SEQ ID NO: 10181 - DNA, 25 bp, Homo sapiens
gcaacgaggtgttcatggacgattg

SEQ ID NO: 10182 - DNA, 24 bp, Homo sapiens
gcaacgcccagatcaccatgctgc

SEQ ID NO: 10183 - DNA, 24 bp, Homo sapiens
tgcaacgcccagatcaccatgctg

SEQ ID NO: 10184 - DNA, 24 bp, Homo sapiens
gtgcaacgcccagatcaccatgct

SEQ ID NO: 10185 - DNA, 23 bp, Homo sapiens
cacctgcttcggctactggctgg

SEQ ID NO: 10186 - DNA, 24 bp, Homo sapiens
agatgttggcactgctgggctatg

SEQ ID NO: 10187 - DNA, 25 bp, Homo sapiens
ctcttctacctcttctggctgttgg

SEQ ID NO: 10188 - DNA, 24 bp, Homo sapiens
atgctggtcttcactctggttgct

SEQ ID NO: 10189 - DNA, 25 bp, Homo sapiens
ccatgggatgaagacgtctgacact

SEQ ID NO: 10190 - DNA, 24 bp, Homo sapiens
gctgatatggccagacctgcagaa

SEQ ID NO: 10191 - DNA, 24 bp, Homo sapiens
ttctgagcagggtaggtgggtagt

SEQ ID NO: 10192 - DNA, 24 bp, Homo sapiens
attctgagcagggtaggtgggtag

SEQ ID NO: 10193 - DNA, 24 bp, Homo sapiens
aattctgagcagggtaggtgggta

SEQ ID NO: 10194 - DNA, 24 bp, Homo sapiens
tgtggtgccaggtgacagtgaagc

SEQ ID NO: 10195 - DNA, 24 bp, Homo sapiens
ctgtggtgccaggtgacagtgaag

SEQ ID NO: 10196 - DNA, 24 bp, Homo sapiens
cctgtggtgccaggtgacagtgaa

SEQ ID NO: 10197 - DNA, 24 bp, Homo sapiens
gctcaagattcaggagaagaggct

SEQ ID NO: 10198 - DNA, 24 bp, Homo sapiens
tgtgacattgctgaagtagatggg

SEQ ID NO: 10199 - DNA, 25 bp, Homo sapiens
aggtgaagaaggagaagttgagcca

SEQ ID NO: 10200 - DNA, 25 bp, Homo sapiens
agacactcccattgaatctttccca

SEQ ID NO: 10201 - DNA, 25 bp, Homo sapiens
cgagcacagacaagccctcagatat

SEQ ID NO: 10202 - DNA, 25 bp, Homo sapiens
acaatgaagccaacagtgtccagtg

SEQ ID NO: 10203 - DNA, 25 bp, Homo sapiens
ctgaagagcaaagataggaccacat

SEQ ID NO: 10204 - DNA, 25 bp, Homo sapiens
agagaaactggatgtgagcaaagga

SEQ ID NO: 10205 - DNA, 25 bp, Homo sapiens
tcaatcacatccgatgagactacct

SEQ ID NO: 10206 - DNA, 25 bp, Homo sapiens
atcagcacaacaggaagcatcagca

SEQ ID NO: 10207 - DNA, 25 bp, Homo sapiens
tcagaggactatctcagaaccagca

SEQ ID NO: 10208 - DNA, 25 bp, Homo sapiens
acggtaacaagtcctagcagaatga

SEQ ID NO: 10209 - DNA, 24 bp, Homo sapiens
cgtactttcaggtaataaaaataa

SEQ ID NO: 10210 - DNA, 24 bp, Homo sapiens
acgtactttcaggtaataaaaata

SEQ ID NO: 10211 - DNA, 24 bp, Homo sapiens
cacgtactttcaggtaataaaaat

SEQ ID NO: 10212 - DNA, 24 bp, Homo sapiens
gcctcgcccggactccgggaatga

SEQ ID NO: 10213 - DNA, 24 bp, Homo sapiens
cgcctcgcccggactccgggaatg

SEQ ID NO: 10214 - DNA, 24 bp, Homo sapiens
ccgcctcgcccggactccgggaat

SEQ ID NO: 10215 - DNA, 23 bp, Homo sapiens
caggatgtctcgccgcaagcaag

SEQ ID NO: 10216 - DNA, 23 bp, Homo sapiens
ctaccggagcgacagcgcagtcc

SEQ ID NO: 10217 - DNA, 25 bp, Homo sapiens
gccttgcttccattttccattatta

SEQ ID NO: 10218 - DNA, 24 bp, Homo sapiens
cgtctgatagcatggaagaaggag

SEQ ID NO: 10219 - DNA, 24 bp, Homo sapiens
agctctgttcataccagtgacctt

SEQ ID NO: 10220 - DNA, 24 bp, Homo sapiens
gccagacagcaatgagaaaggaga

SEQ ID NO: 10221 - DNA, 24 bp, Homo sapiens
aagtgaaccaagtaaacctgcccg

SEQ ID NO: 10222 - DNA, 24 bp, Homo sapiens
acaggaagagactgacacaagaga

SEQ ID NO: 10223 - DNA, 24 bp, Homo sapiens
aaggcaagtagaacgctcagaaat

SEQ ID NO: 10224 - DNA, 24 bp, Homo sapiens
gcagaagccataagcggtcacagt

SEQ ID NO: 10225 - DNA, 24 bp, Homo sapiens
agaggttgaagaggaagaaaggca

SEQ ID NO: 10226 - DNA, 24 bp, Homo sapiens
tctcaggaggaagatcagccaata

SEQ ID NO: 10227 - DNA, 24 bp, Homo sapiens
gcagaagccataagcggtcacagt

SEQ ID NO: 10228 - DNA, 24 bp, Homo sapiens
agaggttgaagaggaagaaaggca

SEQ ID NO: 10229 - DNA, 24 bp, Homo sapiens
cctgaaacggagccacatgacaca

SEQ ID NO: 10230 - DNA, 24 bp, Homo sapiens
caagtgtgcgtcggagaggaagaa

SEQ ID NO: 10231 - DNA, 24 bp, Homo sapiens
ggaagaagaggaagaggacgagcc

SEQ ID NO: 10232 - DNA, 24 bp, Homo sapiens
gcgataatcctgaccactgctgcc

SEQ ID NO: 10233 - DNA, 24 bp, Homo sapiens
agtggaggacaagaaagagcagga

SEQ ID NO: 10234 - DNA, 24 bp, Homo sapiens
tccaccaccagatcagaggctcag

SEQ ID NO: 10235 - DNA, 24 bp, Homo sapiens
gcgataatcctgaccactgctgcc

SEQ ID NO: 10236 - DNA, 24 bp, Homo sapiens
tacacatgaagccagtgatgatca

SEQ ID NO: 10237 - DNA, 24 bp, Homo sapiens
atacacatgaagccagtgatgatc

SEQ ID NO: 10238 - DNA, 24 bp, Homo sapiens
gatacacatgaagccagtgatgat

SEQ ID NO: 10239 - DNA, 24 bp, Homo sapiens
cacaggccaagcaatggttcagca

SEQ ID NO: 10240 - DNA, 24 bp, Homo sapiens
ccacaggccaagcaatggttcagc

SEQ ID NO: 10241 - DNA, 24 bp, Homo sapiens
cccacaggccaagcaatggttcag

SEQ ID NO: 10242 - DNA, 24 bp, Homo sapiens
gcctattaccgcctgctcatcacc

SEQ ID NO: 10243 - DNA, 25 bp, Homo sapiens
tggttcctggacagagcgttatact

SEQ ID NO: 10244 - DNA, 25 bp, Homo sapiens
gggaaaccagcattagcagaagaca

SEQ ID NO: 10245 - DNA, 24 bp, Homo sapiens
ctggcagacctggaggacgataca

SEQ ID NO: 10246 - DNA, 25 bp, Homo sapiens
gggaaaccagcattagcagaagaca

SEQ ID NO: 10247 - DNA, 25 bp, Homo sapiens
tggttcctggacagagcgttatact

SEQ ID NO: 10248 - DNA, 25 bp, Homo sapiens
ttcaccattcatgcctacattgcct

SEQ ID NO: 10249 - DNA, 23 bp, Homo sapiens
atggtgcggagcctgctggatgg

SEQ ID NO: 10250 - DNA, 23 bp, Homo sapiens
agacaagagtgacagccctgcca

SEQ ID NO: 10251 - DNA, 23 bp, Homo sapiens
catccagccacagcctcaaccac

SEQ ID NO: 10252 - DNA, 23 bp, Homo sapiens
atccttcccagccttcagcccag

SEQ ID NO: 10253 - DNA, 23 bp, Homo sapiens
ctcctgcccagccagctcctcag

SEQ ID NO: 10254 - DNA, 25 bp, Homo sapiens
tcatgccatcaactatgttaataag

SEQ ID NO: 10255 - DNA, 25 bp, Homo sapiens
aacagatttcagggccaaccagaca

SEQ ID NO: 10256 - DNA, 25 bp, Homo sapiens
tcctggagattttgcacacatatca

SEQ ID NO: 10257 - DNA, 24 bp, Homo sapiens
catccttgcagaacaatcaacctg

SEQ ID NO: 10258 - DNA, 24 bp, Homo sapiens
ccatccttgcagaacaatcaacct

SEQ ID NO: 10259 - DNA, 24 bp, Homo sapiens
cccatccttgcagaacaatcaacc

SEQ ID NO: 10260 - DNA, 25 bp, Homo sapiens
agcagcagttcatagcagccatcat

SEQ ID NO: 10261 - DNA, 23 bp, Homo sapiens
gccaggtggtccagagtcatgct

SEQ ID NO: 10262 - DNA, 23 bp, Homo sapiens
agaggctgaaggtggaggatgcg

SEQ ID NO: 10263 - DNA, 25 bp, Homo sapiens
gcagttcatagcagccatcatcacc

SEQ ID NO: 10264 - DNA, 23 bp, Homo sapiens
gccaggtggtccagagtcatgct

SEQ ID NO: 10265 - DNA, 23 bp, Homo sapiens
cagttgcaccagtgcagggacag

SEQ ID NO: 10266 - DNA, 23 bp, Homo sapiens
atggtgcggagcctgctggatgg

SEQ ID NO: 10267 - DNA, 25 bp, Homo sapiens
ttcaccattcatgcctacattgcct

SEQ ID NO: 10268 - DNA, 24 bp, Homo sapiens
gcagcatatcgtgagtgatgagat

SEQ ID NO: 10269 - DNA, 23 bp, Homo sapiens
aggttcaagcgattctcctgcct

SEQ ID NO: 10270 - DNA, 23 bp, Homo sapiens
gcagtggcacaatctcagctcac

SEQ ID NO: 10271 - DNA, 23 bp, Homo sapiens
cctgagtagctgggattacaggc

SEQ ID NO: 10272 - DNA, 24 bp, Homo sapiens
tccacaaattgacgcagtaaaacg

SEQ ID NO: 10273 - DNA, 24 bp, Homo sapiens
ctccacaaattgacgcagtaaaac

SEQ ID NO: 10274 - DNA, 24 bp, Homo sapiens
cctccacaaattgacgcagtaaaa

SEQ ID NO: 10275 - DNA, 25 bp, Homo sapiens
aagacagcaacagtcaggacagtgg

SEQ ID NO: 10276 - DNA, 24 bp, Homo sapiens
ggatcgtcagcgttcacctattgc

SEQ ID NO: 10277 - DNA, 23 bp, Homo sapiens
gcaaccaggacctccaggacctc

SEQ ID NO: 10278 - DNA, 23 bp, Homo sapiens
gcaaccaggacctccaggacctc

SEQ ID NO: 10279 - DNA, 24 bp, Homo sapiens
ggatcgtcagcgttcacctattgc

SEQ ID NO: 10280 - DNA, 25 bp, Homo sapiens
gagcctccacaaattgacgcagtaa

SEQ ID NO: 10281 - DNA, 25 bp, Homo sapiens
agcaagagaagcagacggtgatgtg

SEQ ID NO: 10282 - DNA, 25 bp, Homo sapiens
acaaggaaggagtaggtcgggaagt

SEQ ID NO: 10283 - DNA, 25 bp, Homo sapiens
ggtagtcccagtagcaatagcagaa

SEQ ID NO: 10284 - DNA, 24 bp, Homo sapiens
ttcttttacaggttaccgcccaag

SEQ ID NO: 10285 - DNA, 24 bp, Homo sapiens
tttcttttacaggttaccgcccaa

SEQ ID NO: 10286 - DNA, 24 bp, Homo sapiens
ctttcttttacaggttaccgccca

SEQ ID NO: 10287 - DNA, 24 bp, Homo sapiens
tgtagtcccagctactcaggaggc

SEQ ID NO: 10288 - DNA, 24 bp, Homo sapiens
ctgtagtcccagctactcaggagg

SEQ ID NO: 10289 - DNA, 24 bp, Homo sapiens
cctgtagtcccagctactcaggag

SEQ ID NO: 10290 - DNA, 23 bp, Homo sapiens
ggagccagcctacaggtgtgatt

SEQ ID NO: 10291 - DNA, 25 bp, Homo sapiens
atcttattgacctccagaagcacct

SEQ ID NO: 10292 - DNA, 25 bp, Homo sapiens
cagacctcattggatcagcagcact

SEQ ID NO: 10293 - DNA, 23 bp, Homo sapiens
ggagccagcctacaggtgtgatt

SEQ ID NO: 10294 - DNA, 25 bp, Homo sapiens
atccctctgctctatcaagtcccat

SEQ ID NO: 10295 - DNA, 24 bp, Homo sapiens
cctccagaagcacctggataccca

SEQ ID NO: 10296 - DNA, 24 bp, Homo sapiens
ttttgttttaggtgttttgctgga

SEQ ID NO: 10297 - DNA, 24 bp, Homo sapiens
gttttgttttaggtgttttgctgg

SEQ ID NO: 10298 - DNA, 24 bp, Homo sapiens
ggttttgttttaggtgttttgctg

SEQ ID NO: 10299 - DNA, 25 bp, Homo sapiens
ttggtctctattgaagcatggtgtt

SEQ ID NO: 10300 - DNA, 24 bp, Homo sapiens
aagagtctggatggacagcattgc

SEQ ID NO: 10301 - DNA, 24 bp, Homo sapiens
atgccctccaccttgtttcctcct

SEQ ID NO: 10302 - DNA, 23 bp, Homo sapiens
gattgaggcttccagttgtgcag

SEQ ID NO: 10303 - DNA, 25 bp, Homo sapiens
gagtagtaggttagatggagtcaga

SEQ ID NO: 10304 - DNA, 25 bp, Homo sapiens
acagttagtgagaggcagaagagca

SEQ ID NO: 10305 - DNA, 24 bp, Homo sapiens
gtctgccacctcttccttccatgc

SEQ ID NO: 10306 - DNA, 23 bp, Homo sapiens
tcaacctcaacctcccagcacca

SEQ ID NO: 10307 - DNA, 25 bp, Homo sapiens
cttctgtgccaccaatgaatccagc

SEQ ID NO: 10308 - DNA, 24 bp, Homo sapiens
gtctgccacctcttccttccatgc

SEQ ID NO: 10309 - DNA, 23 bp, Homo sapiens
tcaacctcaacctcccagcacca

SEQ ID NO: 10310 - DNA, 24 bp, Homo sapiens
accaggtctgatgcctttaccagc

SEQ ID NO: 10311 - DNA, 24 bp, Homo sapiens
gagaactccaggtctcacttgccc

SEQ ID NO: 10312 - DNA, 24 bp, Homo sapiens
ggagaactccaggtctcacttgcc

SEQ ID NO: 10313 - DNA, 24 bp, Homo sapiens
tggagaactccaggtctcacttgc

SEQ ID NO: 10314 - DNA, 25 bp, Homo sapiens
acagcacagtcttaattcaggacag

SEQ ID NO: 10315 - DNA, 25 bp, Homo sapiens
agaacagttgccaagagtcacagtg

SEQ ID NO: 10316 - DNA, 25 bp, Homo sapiens
atgaaatcaagcccagagaccagca

SEQ ID NO: 10317 - DNA, 24 bp, Homo sapiens
agcaccacatccttcaaccttcgt

SEQ ID NO: 10318 - DNA, 24 bp, Homo sapiens
tcagcacagaggaagtcaccagat

SEQ ID NO: 10319 - DNA, 24 bp, Homo sapiens
tgtgctgttgatggtgccagatgg

SEQ ID NO: 10320 - DNA, 24 bp, Homo sapiens
tcagcacagaggaagtcaccagat

SEQ ID NO: 10321 - DNA, 24 bp, Homo sapiens
tgtgctgttgatggtgccagatgg

SEQ ID NO: 10322 - DNA, 25 bp, Homo sapiens
gccagcctcccataatttagtcaat

SEQ ID NO: 10323 - DNA, 24 bp, Homo sapiens
agaagatcgtgggtggtctggagc

SEQ ID NO: 10324 - DNA, 25 bp, Homo sapiens
gtggagatagagaacgggtgttgga

SEQ ID NO: 10325 - DNA, 23 bp, Homo sapiens
gagccagccactgtcaccatctc

SEQ ID NO: 10326 - DNA, 25 bp, Homo sapiens
gcttatggcaatgacagtgtggaga

SEQ ID NO: 10327 - DNA, 23 bp, Homo sapiens
gagccagccactgtcaccatctc

SEQ ID NO: 10328 - DNA, 24 bp, Homo sapiens
gctgtggctgtccatccattgtgt

SEQ ID NO: 10329 - DNA, 24 bp, Homo sapiens
tacagtgacggccatgcacctgtt

SEQ ID NO: 10330 - DNA, 24 bp, Homo sapiens
ttacagtgacggccatgcacctgt

SEQ ID NO: 10331 - DNA, 24 bp, Homo sapiens
cttacagtgacggccatgcacctg

SEQ ID NO: 10332 - DNA, 24 bp, Homo sapiens
ggtgtctgcgtgagaggcgaatgc

SEQ ID NO: 10333 - DNA, 24 bp, Homo sapiens
acatgcttagaccagtgttcaggc

SEQ ID NO: 10334 - DNA, 24 bp, Homo sapiens
gctggactggacacgactgttcta

SEQ ID NO: 10335 - DNA, 24 bp, Homo sapiens
atgcatgtgctggtcctgtccttc

SEQ ID NO: 10336 - DNA, 24 bp, Homo sapiens
gatgcatgtgctggtcctgtcctt

SEQ ID NO: 10337 - DNA, 24 bp, Homo sapiens
agatgcatgtgctggtcctgtcct

SEQ ID NO: 10338 - DNA, 24 bp, Homo sapiens
gaacactctcaagacctgctccgt

SEQ ID NO: 10339 - DNA, 23 bp, Homo sapiens
atcttggctcaccgcaacctctg

SEQ ID NO: 10340 - DNA, 24 bp, Homo sapiens
gcgattctcctgcttcagccttct

SEQ ID NO: 10341 - DNA, 24 bp, Homo sapiens
cagaaaacgaggtttgagcaatgt

SEQ ID NO: 10342 - DNA, 24 bp, Homo sapiens
tcagaaaacgaggtttgagcaatg

SEQ ID NO: 10343 - DNA, 24 bp, Homo sapiens
ttcagaaaacgaggtttgagcaat

SEQ ID NO: 10344 - DNA, 25 bp, Homo sapiens
tcaccgccccagtgtttatttacat

SEQ ID NO: 10345 - DNA, 25 bp, Homo sapiens
cgtttgctctgtaaatcccagatcc

SEQ ID NO: 10346 - DNA, 25 bp, Homo sapiens
atgtttatctgaatccgttgtattt

SEQ ID NO: 10347 - DNA, 24 bp, Homo sapiens
ccaggttcaagtgattctcgtgcc

SEQ ID NO: 10348 - DNA, 24 bp, Homo sapiens
attacagacatgagccaccgtgcc

SEQ ID NO: 10349 - DNA, 23 bp, Homo sapiens
ccaacctcaggcaatccacccac

SEQ ID NO: 10350 - DNA, 24 bp, Homo sapiens
ggaacctgaggccttcaaacagtg

SEQ ID NO: 10351 - DNA, 24 bp, Homo sapiens
gggaacctgaggccttcaaacagt

SEQ ID NO: 10352 - DNA, 24 bp, Homo sapiens
agggaacctgaggccttcaaacag

SEQ ID NO: 10353 - DNA, 25 bp, Homo sapiens
tggaagtgtaatgccgaacgacagt

SEQ ID NO: 10354 - DNA, 25 bp, Homo sapiens
aagatgaggcagtctcttcctatgc

SEQ ID NO: 10355 - DNA, 25 bp, Homo sapiens
tcccagccatttgtgtacttcagca

SEQ ID NO: 10356 - DNA, 25 bp, Homo sapiens
tcccagccatttgtgtacttcagca

SEQ ID NO: 10357 - DNA, 25 bp, Homo sapiens
caggtccagagaacatggcacactg

SEQ ID NO: 10358 - DNA, 25 bp, Homo sapiens
tcctttcccgaagcatttcatctga

SEQ ID NO: 10359 - DNA, 25 bp, Homo sapiens
acagcagttgaggtcccaaataagg

SEQ ID NO: 10360 - DNA, 25 bp, Homo sapiens
tgttctgggataccttctcacttgg

SEQ ID NO: 10361 - DNA, 25 bp, Homo sapiens
gcagcactgatgtctcttcttagca

SEQ ID NO: 10362 - DNA, 24 bp, Homo sapiens
gcagcccaaaggtaagaattctaa

SEQ ID NO: 10363 - DNA, 24 bp, Homo sapiens
agcagcccaaaggtaagaattcta

SEQ ID NO: 10364 - DNA, 24 bp, Homo sapiens
cagcagcccaaaggtaagaattct

SEQ ID NO: 10365 - DNA, 25 bp, Homo sapiens
gtgtggatgaagatgaggattctga

SEQ ID NO: 10366 - DNA, 25 bp, Homo sapiens
aggagatacagataaagatgggaca

SEQ ID NO: 10367 - DNA, 25 bp, Homo sapiens
attggagctttgatcatgaagaaga

SEQ ID NO: 10368 - DNA, 24 bp, Homo sapiens
aactcttctgccaagcctgtaatt

SEQ ID NO: 10369 - DNA, 24 bp, Homo sapiens
ggcaggaagaaagtgaccctcgtt

SEQ ID NO: 10370 - DNA, 25 bp, Homo sapiens
acatcccagaaagttgctgatagga

SEQ ID NO: 10371 - DNA, 23 bp, Homo sapiens
aaacagcagcccaaagcagtctg

SEQ ID NO: 10372 - DNA, 25 bp, Homo sapiens
aaggttaagtcggctccaaggtgtt

SEQ ID NO: 10373 - DNA, 25 bp, Homo sapiens
acagaagagtccgaatcacaagtgg

SEQ ID NO: 10374 - DNA, 25 bp, Homo sapiens
agcctactcctcctctatctcctgc

SEQ ID NO: 10375 - DNA, 25 bp, Homo sapiens
agaggaaagtacaacagaaacggca

SEQ ID NO: 10376 - DNA, 25 bp, Homo sapiens
acagaagagtccgaatcacaagtgg

SEQ ID NO: 10377 - DNA, 25 bp, Homo sapiens
actacgaagcattccagaagactca

SEQ ID NO: 10378 - DNA, 25 bp, Homo sapiens
tgatgacaacgacagaactaacaga

SEQ ID NO: 10379 - DNA, 25 bp, Homo sapiens
ccactggaaaagtagaagcagcact

SEQ ID NO: 10380 - DNA, 25 bp, Homo sapiens
gcccttctcggtcaaatgttgtcaa

SEQ ID NO: 10381 - DNA, 25 bp, Homo sapiens
agtgactgtggtgtatatgtattgc

SEQ ID NO: 10382 - DNA, 24 bp, Homo sapiens
ttcctccaccaagaatgagaacaa

SEQ ID NO: 10383 - DNA, 25 bp, Homo sapiens
ttccaaagatgttatgaagggctct

SEQ ID NO: 10384 - DNA, 25 bp, Homo sapiens
agtgactgtggtgtatatgtattgc

SEQ ID NO: 10385 - DNA, 24 bp, Homo sapiens
ttcctccaccaagaatgagaacaa

SEQ ID NO: 10386 - DNA, 24 bp, Homo sapiens
ttcctccaccaagaatgagaacaa

SEQ ID NO: 10387 - DNA, 25 bp, Homo sapiens
ggacacttactcaacagaagcacct

SEQ ID NO: 10388 - DNA, 25 bp, Homo sapiens
tgaagctacaggaagatcagagcaa

SEQ ID NO: 10389 - DNA, 25 bp, Homo sapiens
cacctaccaccactgctgctaacac

SEQ ID NO: 10390 - DNA, 25 bp, Homo sapiens
ccattagcatatcctcctccacagt

SEQ ID NO: 10391 - DNA, 23 bp, Homo sapiens
cagatccgtccaccaaggttgcc

SEQ ID NO: 10392 - DNA, 25 bp, Homo sapiens
caacaacagtcacaaccacggcaag

SEQ ID NO: 10393 - DNA, 25 bp, Homo sapiens
agtccaagttcaccttctgtccgaa

SEQ ID NO: 10394 - DNA, 25 bp, Homo sapiens
tcattctaatcagcaacaacctccg

SEQ ID NO: 10395 - DNA, 25 bp, Homo sapiens
aagtgccaggattacaggtgtgaat

SEQ ID NO: 10396 - DNA, 25 bp, Homo sapiens
gccaggattacaggtgtgaaccact

SEQ ID NO: 10397 - DNA, 23 bp, Homo sapiens
gtgatccgcccacctcagcctcc

SEQ ID NO: 10398 - DNA, 24 bp, Homo sapiens
ctattgttcagtcctcactaggct

SEQ ID NO: 10399 - DNA, 24 bp, Homo sapiens
gctattgttcagtcctcactaggc

SEQ ID NO: 10400 - DNA, 24 bp, Homo sapiens
agctattgttcagtcctcactagg

SEQ ID NO: 10401 - DNA, 25 bp, Homo sapiens
aggctcatcgacttcttcattccag

SEQ ID NO: 10402 - DNA, 24 bp, Homo sapiens
cgagttccttagttgggcagcagt

SEQ ID NO: 10403 - DNA, 23 bp, Homo sapiens
caggatgcccacatacagtcagt

SEQ ID NO: 10404 - DNA, 24 bp, Homo sapiens
gctcatcgacttcttcattccagt

SEQ ID NO: 10405 - DNA, 23 bp, Homo sapiens
aagtagtgcggttggttctgcct

SEQ ID NO: 10406 - DNA, 24 bp, Homo sapiens
ttggtgctgttggtgttgctggaa

SEQ ID NO: 10407 - DNA, 25 bp, Homo sapiens
acagtcagttcagtccgagttcctt

SEQ ID NO: 10408 - DNA, 23 bp, Homo sapiens
actcatgcctcagccttccaagt

SEQ ID NO: 10409 - DNA, 24 bp, Homo sapiens
ctacttgggaggctgaggcaggag

SEQ ID NO: 10410 - DNA, 24 bp, Homo sapiens
gctacttgggaggctgaggcagga

SEQ ID NO: 10411 - DNA, 24 bp, Homo sapiens
agctacttgggaggctgaggcagg

SEQ ID NO: 10412 - DNA, 25 bp, Homo sapiens
actggaattgactattggttggaca

SEQ ID NO: 10413 - DNA, 25 bp, Homo sapiens
aatgtgccagagcttgtgatgtgtt

SEQ ID NO: 10414 - DNA, 25 bp, Homo sapiens
gcaagtggcagcgatatagtgaagc

SEQ ID NO: 10415 - DNA, 25 bp, Homo sapiens
cgctaaggtcattgggaacacgaga

SEQ ID NO: 10416 - DNA, 25 bp, Homo sapiens
actatggcaactctacagcaagatt

SEQ ID NO: 10417 - DNA, 25 bp, Homo sapiens
ctgcgatgtggattcagtgtctgct

SEQ ID NO: 10418 - DNA, 24 bp, Homo sapiens
atcctcgacaggccaaccaggatc

SEQ ID NO: 10419 - DNA, 24 bp, Homo sapiens
catcctcgacaggccaaccaggat

SEQ ID NO: 10420 - DNA, 24 bp, Homo sapiens
ccatcctcgacaggccaaccagga

SEQ ID NO: 10421 - DNA, 25 bp, Homo sapiens
tggaagatgaggaggtcgctgagag

SEQ ID NO: 10422 - DNA, 23 bp, Homo sapiens
ggggggaggagggaaagcggcga

SEQ ID NO: 10423 - DNA, 23 bp, Homo sapiens
agcctttgggtcctgatgggtct

SEQ ID NO: 10424 - DNA, 23 bp, Homo sapiens
gttgctgccgtcaccgcctcctg

SEQ ID NO: 10425 - DNA, 24 bp, Homo sapiens
tggacttgagcagagggaacgacc

SEQ ID NO: 10426 - DNA, 25 bp, Homo sapiens
gggcttagaagtgacggagagaaga

SEQ ID NO: 10427 - DNA, 24 bp, Homo sapiens
cagagtgccagggagtgagattgc

SEQ ID NO: 10428 - DNA, 25 bp, Homo sapiens
tgggagatagggaaagtgaaccgac

SEQ ID NO: 10429 - DNA, 24 bp, Homo sapiens
gggcacaacaggtggagaaggaaa

SEQ ID NO: 10430 - DNA, 24 bp, Homo sapiens
tgggcacaacaggtggagaaggaa

SEQ ID NO: 10431 - DNA, 24 bp, Homo sapiens
atgggcacaacaggtggagaagga

SEQ ID NO: 10432 - DNA, 23 bp, Homo sapiens
caccaagggacagtagccagagc

SEQ ID NO: 10433 - DNA, 25 bp, Homo sapiens
gcttggtggttgtgagtccattcat

SEQ ID NO: 10434 - DNA, 23 bp, Homo sapiens
gcacagatgaggaaaccaaggca

SEQ ID NO: 10435 - DNA, 24 bp, Homo sapiens
ccagcaggagaccatagacagact

SEQ ID NO: 10436 - DNA, 23 bp, Homo sapiens
ggaggagtccattctgagccgaa

SEQ ID NO: 10437 - DNA, 23 bp, Homo sapiens
ctggacaggcggctgatcctcat

SEQ ID NO: 10438 - DNA, 23 bp, Homo sapiens
ccagaacagccacccagaccaga

SEQ ID NO: 10439 - DNA, 24 bp, Homo sapiens
ataactgtccagctctgtgcatca

SEQ ID NO: 10440 - DNA, 25 bp, Homo sapiens
agcggcaccagaaggatataaccag

SEQ ID NO: 10441 - DNA, 23 bp, Homo sapiens
ggaggagtccattctgagccgaa

SEQ ID NO: 10442 - DNA, 24 bp, Homo sapiens
ggaggctttccaggccaaaatgaa

SEQ ID NO: 10443 - DNA, 24 bp, Homo sapiens
ccgatgcaaagttccaggtattcc

SEQ ID NO: 10444 - DNA, 24 bp, Homo sapiens
accgatgcaaagttccaggtattc

SEQ ID NO: 10445 - DNA, 24 bp, Homo sapiens
caccgatgcaaagttccaggtatt

SEQ ID NO: 10446 - DNA, 24 bp, Homo sapiens
gaggtgttgatcttcttgtagaaa

SEQ ID NO: 10447 - DNA, 24 bp, Homo sapiens
ggaggtgttgatcttcttgtagaa

SEQ ID NO: 10448 - DNA, 24 bp, Homo sapiens
tggaggtgttgatcttcttgtaga

SEQ ID NO: 10449 - DNA, 25 bp, Homo sapiens
tgtccttcctcttccgcctcatcaa

SEQ ID NO: 10450 - DNA, 23 bp, Homo sapiens
tactgtctgaatgccgcctgctc

SEQ ID NO: 10451 - DNA, 23 bp, Homo sapiens
aaaccaggtggatatgaaagttg

SEQ ID NO: 10452 - DNA, 24 bp, Homo sapiens
gctgtgacgagctgatattcagca

SEQ ID NO: 10453 - DNA, 24 bp, Homo sapiens
ggctgtgacgagctgatattcagc

SEQ ID NO: 10454 - DNA, 24 bp, Homo sapiens
tggctgtgacgagctgatattcag

SEQ ID NO: 10455 - DNA, 24 bp, Homo sapiens
tttgagcaattctcctgcctcagc

SEQ ID NO: 10456 - DNA, 24 bp, Homo sapiens
ttttgagcaattctcctgcctcag

SEQ ID NO: 10457 - DNA, 24 bp, Homo sapiens
attttgagcaattctcctgcctca

SEQ ID NO: 10458 - DNA, 24 bp, Homo sapiens
ctcagatgatccgcctgccttggc

SEQ ID NO: 10459 - DNA, 24 bp, Homo sapiens
cctcagatgatccgcctgccttgg

SEQ ID NO: 10460 - DNA, 24 bp, Homo sapiens
acctcagatgatccgcctgccttg

SEQ ID NO: 10461 - DNA, 24 bp, Homo sapiens
tttgagcaattcgcctgccttggc

SEQ ID NO: 10462 - DNA, 24 bp, Homo sapiens
ttttgagcaattcgcctgccttgg

SEQ ID NO: 10463 - DNA, 24 bp, Homo sapiens
attttgagcaattcgcctgccttg

SEQ ID NO: 10464 - DNA, 25 bp, Homo sapiens
cctcatccactcaacacattcactg

SEQ ID NO: 10465 - DNA, 23 bp, Homo sapiens
gccttccctgcctgaactttgaa

SEQ ID NO: 10466 - DNA, 24 bp, Homo sapiens
agaaggcatctgaggagaatgaga

SEQ ID NO: 10467 - DNA, 24 bp, Homo sapiens
ttgaccatcagtctgtgacctgcc

SEQ ID NO: 10468 - DNA, 24 bp, Homo sapiens
agaaggcatctgaggagaatgaga

SEQ ID NO: 10469 - DNA, 23 bp, Homo sapiens
gccttccctgcctgaactttgaa

SEQ ID NO: 10470 - DNA, 25 bp, Homo sapiens
actcatttcacttgttgcttacggt

SEQ ID NO: 10471 - DNA, 25 bp, Homo sapiens
gcatgagctggaaatgtaggaacct

SEQ ID NO: 10472 - DNA, 23 bp, Homo sapiens
gagtcgaaggactagaatgagat

SEQ ID NO: 10473 - DNA, 24 bp, Homo sapiens
acctgaagagtgacaccattgatt

SEQ ID NO: 10474 - DNA, 24 bp, Homo sapiens
agaaggcatctgaggagaatgaga

SEQ ID NO: 10475 - DNA, 23 bp, Homo sapiens
gccttccctgcctgaactttgaa

SEQ ID NO: 10476 - DNA, 23 bp, Homo sapiens
cacgatctcggctcaccacaacc

SEQ ID NO: 10477 - DNA, 25 bp, Homo sapiens
gggattacagcataagcctacaggg

SEQ ID NO: 10478 - DNA, 23 bp, Homo sapiens
cttcctattacctatttcacaga

SEQ ID NO: 10479 - DNA, 25 bp, Homo sapiens
gctggtggtgaagtctgagtggaag

SEQ ID NO: 10480 - DNA, 23 bp, Homo sapiens
aggacttctggctgactgctgcc

SEQ ID NO: 10481 - DNA, 24 bp, Homo sapiens
ccctgactcgggcctcctttcatg

SEQ ID NO: 10482 - DNA, 24 bp, Homo sapiens
accctgactcgggcctcctttcat

SEQ ID NO: 10483 - DNA, 24 bp, Homo sapiens
gaccctgactcgggcctcctttca

SEQ ID NO: 10484 - DNA, 24 bp, Homo sapiens
gtgtgactttgggtttgcagttac

SEQ ID NO: 10485 - DNA, 24 bp, Homo sapiens
tgtgtgactttgggtttgcagtta

SEQ ID NO: 10486 - DNA, 24 bp, Homo sapiens
gtgtgtgactttgggtttgcagtt

SEQ ID NO: 10487 - DNA, 24 bp, Homo sapiens
aggaagaggaggtttttcagccca

SEQ ID NO: 10488 - DNA, 24 bp, Homo sapiens
gaggaagaggaggtttttcagccc

SEQ ID NO: 10489 - DNA, 24 bp, Homo sapiens
agaggaagaggaggtttttcagcc

SEQ ID NO: 10490 - DNA, 25 bp, Homo sapiens
aactctccgagatgcttagcctctt

SEQ ID NO: 10491 - DNA, 24 bp, Homo sapiens
cttcaacaacgcagccagaccatt

SEQ ID NO: 10492 - DNA, 25 bp, Homo sapiens
ttgtatgctactttcaaggagttca

SEQ ID NO: 10493 - DNA, 25 bp, Homo sapiens
ccgcaactgaacttgatactgaacc

SEQ ID NO: 10494 - DNA, 25 bp, Homo sapiens
aaataggaaagatgaaagtcgtgct

SEQ ID NO: 10495 - DNA, 25 bp, Homo sapiens
tgaatctgaagagtctgcggaggaa

SEQ ID NO: 10496 - DNA, 25 bp, Homo sapiens
aacactgctctcagaaggatactgc

SEQ ID NO: 10497 - DNA, 25 bp, Homo sapiens
tggaatcatgctgaagagcgacaga

SEQ ID NO: 10498 - DNA, 25 bp, Homo sapiens
tcttcctcctgaggtaatgctgtca

SEQ ID NO: 10499 - DNA, 24 bp, Homo sapiens
cttcaacaacgcagccagaccatt

SEQ ID NO: 10500 - DNA, 25 bp, Homo sapiens
agcctactactgttgactggaagcc

SEQ ID NO: 10501 - DNA, 25 bp, Homo sapiens
aactctccgagatgcttagcctctt

SEQ ID NO: 10502 - DNA, 25 bp, Homo sapiens
aacaacgatttccgtgctcttctgc

SEQ ID NO: 10503 - DNA, 24 bp, Homo sapiens
tgtatgctactttcaaggagttca

SEQ ID NO: 10504 - DNA, 25 bp, Homo sapiens
atgagcagattgaaaatgaatacat

SEQ ID NO: 10505 - DNA, 25 bp, Homo sapiens
acaactgaaagagagattggaggct

SEQ ID NO: 10506 - DNA, 25 bp, Homo sapiens
aacactgctctcagaaggatactgc

SEQ ID NO: 10507 - DNA, 25 bp, Homo sapiens
tggaatcatgctgaagagcgacaga

SEQ ID NO: 10508 - DNA, 25 bp, Homo sapiens
gtgatgattgtggcagaagatgtcg

SEQ ID NO: 10509 - DNA, 23 bp, Homo sapiens
caccgtgtggtcctggcagcctg

SEQ ID NO: 10510 - DNA, 25 bp, Homo sapiens
catcttcttcctggagctggcaaca

SEQ ID NO: 10511 - DNA, 25 bp, Homo sapiens
gctcaacctcttcatcaacaacaac

SEQ ID NO: 10512 - DNA, 24 bp, Homo sapiens
gacgacattgacctccagaacctc

SEQ ID NO: 10513 - DNA, 24 bp, Homo sapiens
tgcgtcctcagcgtgtgccgctta

SEQ ID NO: 10514 - DNA, 24 bp, Homo sapiens
ttgcgtcctcagcgtgtgccgctt

SEQ ID NO: 10515 - DNA, 24 bp, Homo sapiens
tttgcgtcctcagcgtgtgccgct

SEQ ID NO: 10516 - DNA, 24 bp, Homo sapiens
aggagcttgaggcaagtagcaagg

SEQ ID NO: 10517 - DNA, 24 bp, Homo sapiens
gaggagcttgaggcaagtagcaag

SEQ ID NO: 10518 - DNA, 24 bp, Homo sapiens
agaggagcttgaggcaagtagcaa

SEQ ID NO: 10519 - DNA, 24 bp, Homo sapiens
ctccctcccaggtgcccgcccctg

SEQ ID NO: 10520 - DNA, 24 bp, Homo sapiens
cctccctcccaggtgcccgcccct

SEQ ID NO: 10521 - DNA, 24 bp, Homo sapiens
ccctccctcccaggtgcccgcccc

SEQ ID NO: 10522 - DNA, 24 bp, Homo sapiens
cctgctgccaggcccacacagctg

SEQ ID NO: 10523 - DNA, 24 bp, Homo sapiens
ccctgctgccaggcccacacagct

SEQ ID NO: 10524 - DNA, 24 bp, Homo sapiens
cccctgctgccaggcccacacagc

SEQ ID NO: 10525 - DNA, 24 bp, Homo sapiens
agaatccgatcaaaatcctcacct

SEQ ID NO: 10526 - DNA, 24 bp, Homo sapiens
ctccagacagaccagactctcaca

SEQ ID NO: 10527 - DNA, 24 bp, Homo sapiens
tgagcagatgatggaacagaagga

SEQ ID NO: 10528 - DNA, 24 bp, Homo sapiens
tgactgagaagatggagaacgaca

SEQ ID NO: 10529 - DNA, 23 bp, Homo sapiens
ccatcctcccacctcagcctacc

SEQ ID NO: 10530 - DNA, 23 bp, Homo sapiens
tgcagcctccctctgcctcccgg

SEQ ID NO: 10531 - DNA, 25 bp, Homo sapiens
ggaatcgcctagactctcgcactga

SEQ ID NO: 10532 - DNA, 25 bp, Homo sapiens
cgcttcattgacaccactcttgcca

SEQ ID NO: 10533 - DNA, 25 bp, Homo sapiens
cccaggagaatgacagaagcaaagg

SEQ ID NO: 10534 - DNA, 25 bp, Homo sapiens
gtgaccctgattgcccagtctcaag

SEQ ID NO: 10535 - DNA, 23 bp, Homo sapiens
gggcagccttccatgagcacttg

SEQ ID NO: 10536 - DNA, 25 bp, Homo sapiens
ggcatattcttcccgaggatcaccc

SEQ ID NO: 10537 - DNA, 25 bp, Homo sapiens
agaactcatagaacggaagaccagc

SEQ ID NO: 10538 - DNA, 25 bp, Homo sapiens
gctaatgctcatctgaaggacttgg

SEQ ID NO: 10539 - DNA, 25 bp, Homo sapiens
gtctacaggaaccgcacacttcaga

SEQ ID NO: 10540 - DNA, 24 bp, Homo sapiens
ccagcctgtgtctgttctcctcga

SEQ ID NO: 10541 - DNA, 24 bp, Homo sapiens
gagaagctgagcagtgattgtggc

SEQ ID NO: 10542 - DNA, 24 bp, Homo sapiens
tctgttcctgctcctacgatgcca

SEQ ID NO: 10543 - DNA, 24 bp, Homo sapiens
acccaccgcaggctccctcaacct

SEQ ID NO: 10544 - DNA, 24 bp, Homo sapiens
cacccaccgcaggctccctcaacc

SEQ ID NO: 10545 - DNA, 24 bp, Homo sapiens
acacccaccgcaggctccctcaac

SEQ ID NO: 10546 - DNA, 24 bp, Homo sapiens
tctgacctcaggtgatccgcccgc

SEQ ID NO: 10547 - DNA, 24 bp, Homo sapiens
atctgacctcaggtgatccgcccg

SEQ ID NO: 10548 - DNA, 24 bp, Homo sapiens
catctgacctcaggtgatccgccc

SEQ ID NO: 10549 - DNA, 24 bp, Homo sapiens
attctcctgcctcagcctccagag

SEQ ID NO: 10550 - DNA, 24 bp, Homo sapiens
tggtcagactggtctcgaactcct

SEQ ID NO: 10551 - DNA, 24 bp, Homo sapiens
atctgcccacctcagcctcccaaa

SEQ ID NO: 10552 - DNA, 24 bp, Homo sapiens
gttctgcggccgttgagtagtttt

SEQ ID NO: 10553 - DNA, 24 bp, Homo sapiens
cgttctgcggccgttgagtagttt

SEQ ID NO: 10554 - DNA, 24 bp, Homo sapiens
ccgttctgcggccgttgagtagtt

SEQ ID NO: 10555 - DNA, 25 bp, Homo sapiens
caagaaggaaccaagagaccgaggc

SEQ ID NO: 10556 - DNA, 23 bp, Homo sapiens
gtgaagcagccgagaccgacccg

SEQ ID NO: 10557 - DNA, 23 bp, Homo sapiens
gacccgacaccgccaccctcgct

SEQ ID NO: 10558 - DNA, 23 bp, Homo sapiens
gtgaagcagccgagaccgacccg

SEQ ID NO: 10559 - DNA, 25 bp, Homo sapiens
gggctcggaacacacatttattatt

SEQ ID NO: 10560 - DNA, 25 bp, Homo sapiens
gttagtgctgagagtgcggagtgtg

SEQ ID NO: 10561 - DNA, 25 bp, Homo sapiens
caagaaggaaccaagagaccgaggc

SEQ ID NO: 10562 - DNA, 23 bp, Homo sapiens
gtgaagcagccgagaccgacccg

SEQ ID NO: 10563 - DNA, 25 bp, Homo sapiens
gggctcggaacacacatttattatt

SEQ ID NO: 10564 - DNA, 24 bp, Homo sapiens
cctcgctccccgccggcagccggc

SEQ ID NO: 10565 - DNA, 24 bp, Homo sapiens
ccctcgctccccgccggcagccgg

SEQ ID NO: 10566 - DNA, 24 bp, Homo sapiens
accctcgctccccgccggcagccg

SEQ ID NO: 10567 - DNA, 24 bp, Homo sapiens
cgcagagccaggtaagcggccctc

SEQ ID NO: 10568 - DNA, 24 bp, Homo sapiens
ccgcagagccaggtaagcggccct

SEQ ID NO: 10569 - DNA, 24 bp, Homo sapiens
gccgcagagccaggtaagcggccc

SEQ ID NO: 10570 - DNA, 24 bp, Homo sapiens
gacacgtccagctgttgggtagat

SEQ ID NO: 10571 - DNA, 24 bp, Homo sapiens
agacacgtccagctgttgggtaga

SEQ ID NO: 10572 - DNA, 24 bp, Homo sapiens
gagacacgtccagctgttgggtag

SEQ ID NO: 10573 - DNA, 24 bp, Homo sapiens
cctccattgtggagctggagtggc

SEQ ID NO: 10574 - DNA, 24 bp, Homo sapiens
acctccattgtggagctggagtgg

SEQ ID NO: 10575 - DNA, 24 bp, Homo sapiens
gacctccattgtggagctggagtg

SEQ ID NO: 10576 - DNA, 25 bp, Homo sapiens
tgagaagacagtagaggtgctggag

SEQ ID NO: 10577 - DNA, 23 bp, Homo sapiens
caacgagcagcccaaccgagtag

SEQ ID NO: 10578 - DNA, 23 bp, Homo sapiens
atgagtatgcggtcatgctgtac

SEQ ID NO: 10579 - DNA, 23 bp, Homo sapiens
agagtctcgcttcgtcacccagg

SEQ ID NO: 10580 - DNA, 23 bp, Homo sapiens
agctcactgcaacctccacctcc

SEQ ID NO: 10581 - DNA, 24 bp, Homo sapiens
caagcaattctgcctcaccctccc

SEQ ID NO: 10582 - DNA, 23 bp, Homo sapiens
catgccctggattctaacggacc

SEQ ID NO: 10583 - DNA, 25 bp, Homo sapiens
tggagtatgtcctctaccctctgga

SEQ ID NO: 10584 - DNA, 24 bp, Homo sapiens
cgcctactatgctctgaccaagtt

SEQ ID NO: 10585 - DNA, 23 bp, Homo sapiens
caacgagcagcccaaccgagtag

SEQ ID NO: 10586 - DNA, 25 bp, Homo sapiens
tgagaagacagtagaggtgctggag

SEQ ID NO: 10587 - DNA, 25 bp, Homo sapiens
aagaatgaccactctgcctacaaga

SEQ ID NO: 10588 - DNA, 23 bp, Homo sapiens
tagaggtgctggagccggaggtc

SEQ ID NO: 10589 - DNA, 25 bp, Homo sapiens
agcccaaccgagtagagatctatga

SEQ ID NO: 10590 - DNA, 25 bp, Homo sapiens
tgagaagacagtagaggtgctggag

SEQ ID NO: 10591 - DNA, 23 bp, Homo sapiens
caacgagcagcccaaccgagtag

SEQ ID NO: 10592 - DNA, 25 bp, Homo sapiens
tgaatgagatgctggaggaaggaca

SEQ ID NO: 10593 - DNA, 25 bp, Homo sapiens
ccagtctatccaggagtcgcagaac

SEQ ID NO: 10594 - DNA, 25 bp, Homo sapiens
ccagtgtctccaccagcaacttgaa

SEQ ID NO: 10595 - DNA, 25 bp, Homo sapiens
acgagaacaagatgtacctgactcc

SEQ ID NO: 10596 - DNA, 24 bp, Homo sapiens
cgcctactatgctctgaccaagtt

SEQ ID NO: 10597 - DNA, 24 bp, Homo sapiens
tggctggcagtgtcctgttggata

SEQ ID NO: 10598 - DNA, 24 bp, Homo sapiens
gctgagtgtaagaattatggcgtc

SEQ ID NO: 10599 - DNA, 24 bp, Homo sapiens
cgcctactatgctctgaccaagtt

SEQ ID NO: 10600 - DNA, 24 bp, Homo sapiens
tggctggcagtgtcctgttggata

SEQ ID NO: 10601 - DNA, 25 bp, Homo sapiens
ccgtatccaccgtccaatcgctatg

SEQ ID NO: 10602 - DNA, 24 bp, Homo sapiens
tggctggcagtgtcctgttggata

SEQ ID NO: 10603 - DNA, 25 bp, Homo sapiens
ccgtatccaccgtccaatcgctatg

SEQ ID NO: 10604 - DNA, 25 bp, Homo sapiens
acttgaacagactcattacccagcg

SEQ ID NO: 10605 - DNA, 25 bp, Homo sapiens
ccgtatccaccgtccaatcgctatg

SEQ ID NO: 10606 - DNA, 25 bp, Homo sapiens
acttgaacagactcattacccagcg

SEQ ID NO: 10607 - DNA, 23 bp, Homo sapiens
gccgctttgagagtgaggacctg

SEQ ID NO: 10608 - DNA, 23 bp, Homo sapiens
gccgctttgagagtgaggacctg

SEQ ID NO: 10609 - DNA, 24 bp, Homo sapiens
ggagtggctgctggagattaaccg

SEQ ID NO: 10610 - DNA, 25 bp, Homo sapiens
aaccacaacgagacaaacctgccaa

SEQ ID NO: 10611 - DNA, 25 bp, Homo sapiens
ctctgccgccatgtataaatccttg

SEQ ID NO: 10612 - DNA, 24 bp, Homo sapiens
gctatcagccgctttgagagtgag

SEQ ID NO: 10613 - DNA, 23 bp, Homo sapiens
gacttgaacagactcattaccca

SEQ ID NO: 10614 - DNA, 25 bp, Homo sapiens
aaccacaacgagacaaacctgccaa

SEQ ID NO: 10615 - DNA, 25 bp, Homo sapiens
aagcctctcaacattgcctacagcc

SEQ ID NO: 10616 - DNA, 23 bp, Homo sapiens
cgctgtggtcatggaggaactgc

SEQ ID NO: 10617 - DNA, 23 bp, Homo sapiens
gacagcttcgatgccatgttccg

SEQ ID NO: 10618 - DNA, 24 bp, Homo sapiens
ctcacgcatcggctgctctgtaag

SEQ ID NO: 10619 - DNA, 25 bp, Homo sapiens
tttgactttctccccaactactgct

SEQ ID NO: 10620 - DNA, 25 bp, Homo sapiens
acttgaacagactcattacccagcg

SEQ ID NO: 10621 - DNA, 25 bp, Homo sapiens
ccgtatccaccgtccaatcgctatg

SEQ ID NO: 10622 - DNA, 24 bp, Homo sapiens
gctgagtgtaagaattatggcgtc

SEQ ID NO: 10623 - DNA, 24 bp, Homo sapiens
ggagtggctgctggagattaaccg

SEQ ID NO: 10624 - DNA, 23 bp, Homo sapiens
gccgctttgagagtgaggacctg

SEQ ID NO: 10625 - DNA, 25 bp, Homo sapiens
acttgaacagactcattacccagcg

SEQ ID NO: 10626 - DNA, 23 bp, Homo sapiens
gctccatgccgcacccttccaaa

SEQ ID NO: 10627 - DNA, 23 bp, Homo sapiens
ccgctccacctggtccctctgat

SEQ ID NO: 10628 - DNA, 24 bp, Homo sapiens
cggatgaaacgtctggaagccaag

SEQ ID NO: 10629 - DNA, 25 bp, Homo sapiens
tgaagtccgtggagacagacagttc

SEQ ID NO: 10630 - DNA, 25 bp, Homo sapiens
tggaggaggaagagaagcaggagag

SEQ ID NO: 10631 - DNA, 23 bp, Homo sapiens
ccacagccagcctgccataggat

SEQ ID NO: 10632 - DNA, 23 bp, Homo sapiens
gtgccacaatgcctgccgtctcc

SEQ ID NO: 10633 - DNA, 23 bp, Homo sapiens
ccgcctgaccttggactgacctc

SEQ ID NO: 10634 - DNA, 24 bp, Homo sapiens
gcgaggctggtacacctacacaga

SEQ ID NO: 10635 - DNA, 24 bp, Homo sapiens
cgtccttcagagtgagtccagcac

SEQ ID NO: 10636 - DNA, 24 bp, Homo sapiens
gcgtccttcagagtgagtccagca

SEQ ID NO: 10637 - DNA, 24 bp, Homo sapiens
agcgtccttcagagtgagtccagc

SEQ ID NO: 10638 - DNA, 24 bp, Homo sapiens
tgaagtgaaagccgctcctgacat

SEQ ID NO: 10639 - DNA, 24 bp, Homo sapiens
ttgaagtgaaagccgctcctgaca

SEQ ID NO: 10640 - DNA, 24 bp, Homo sapiens
attgaagtgaaagccgctcctgac

SEQ ID NO: 10641 - DNA, 25 bp, Homo sapiens
cggcgtgagtgtgctgagaataacc

SEQ ID NO: 10642 - DNA, 24 bp, Homo sapiens
cagtggtggtacgcagaagtcaac

SEQ ID NO: 10643 - DNA, 23 bp, Homo sapiens
gagctgtactgtgacgtggtcgg

SEQ ID NO: 10644 - DNA, 24 bp, Homo sapiens
cttggaggactctgggacttacga

SEQ ID NO: 10645 - DNA, 25 bp, Homo sapiens
cggcgtgagtgtgctgagaataacc

SEQ ID NO: 10646 - DNA, 24 bp, Homo sapiens
cagtggtggtacgcagaagtcaac

SEQ ID NO: 10647 - DNA, 24 bp, Homo sapiens
aaccaactctaccaacaatcacaa

SEQ ID NO: 10648 - DNA, 25 bp, Homo sapiens
aactggtggcaacatgacctgctaa

SEQ ID NO: 10649 - DNA, 25 bp, Homo sapiens
agtgagcaacaccacaatgactgtc

SEQ ID NO: 10650 - DNA, 23 bp, Homo sapiens
ctggtggcaacatgacctgctaa

SEQ ID NO: 10651 - DNA, 25 bp, Homo sapiens
gcttggacctctttggttctctccc

SEQ ID NO: 10652 - DNA, 25 bp, Homo sapiens
agtgagcaacaccacaatgactgtc

SEQ ID NO: 10653 - DNA, 24 bp, Homo sapiens
taccgagttaggtctggctctggg

SEQ ID NO: 10654 - DNA, 24 bp, Homo sapiens
ttaccgagttaggtctggctctgg

SEQ ID NO: 10655 - DNA, 24 bp, Homo sapiens
cttaccgagttaggtctggctctg

SEQ ID NO: 10656 - DNA, 25 bp, Homo sapiens
ataaagaaggttgaaaggagcaggg

SEQ ID NO: 10657 - DNA, 23 bp, Homo sapiens
acctcatcagtgtgcatagtggc

SEQ ID NO: 10658 - DNA, 23 bp, Homo sapiens
tccagaagcatgttagttcgaca

SEQ ID NO: 10659 - DNA, 24 bp, Homo sapiens
gcagaggccagagctattaagaat

SEQ ID NO: 10660 - DNA, 24 bp, Homo sapiens
tgcagaggccagagctattaagaa

SEQ ID NO: 10661 - DNA, 24 bp, Homo sapiens
ctgcagaggccagagctattaaga

SEQ ID NO: 10662 - DNA, 23 bp, Homo sapiens
ggactacattagaccagccagcc

SEQ ID NO: 10663 - DNA, 23 bp, Homo sapiens
agagcgtacctgtgccactgtca

SEQ ID NO: 10664 - DNA, 25 bp, Homo sapiens
cacactacgatgaactgcttgctgc

SEQ ID NO: 10665 - DNA, 23 bp, Homo sapiens
agagcgtacctgtgccactgtca

SEQ ID NO: 10666 - DNA, 25 bp, Homo sapiens
cacactacgatgaactgcttgctgc

SEQ ID NO: 10667 - DNA, 25 bp, Homo sapiens
agaaggaagtgcctatccaccgtgt

SEQ ID NO: 10668 - DNA, 25 bp, Homo sapiens
caagaaggaagtgcctatccaccgt

SEQ ID NO: 10669 - DNA, 25 bp, Homo sapiens
cacactacgatgaactgcttgctgc

SEQ ID NO: 10670 - DNA, 23 bp, Homo sapiens
agagcgtacctgtgccactgtca

SEQ ID NO: 10671 - DNA, 24 bp, Homo sapiens
ccggcaagaagaggctgcctacca

SEQ ID NO: 10672 - DNA, 24 bp, Homo sapiens
cccggcaagaagaggctgcctacc

SEQ ID NO: 10673 - DNA, 24 bp, Homo sapiens
ccccggcaagaagaggctgcctac

SEQ ID NO: 10674 - DNA, 24 bp, Homo sapiens
caatgttggagccgtctgcaaagt

SEQ ID NO: 10675 - DNA, 24 bp, Homo sapiens
atagcagcacggtaatgatgacat

SEQ ID NO: 10676 - DNA, 24 bp, Homo sapiens
catagcagcacggtaatgatgaca

SEQ ID NO: 10677 - DNA, 24 bp, Homo sapiens
acatagcagcacggtaatgatgac

SEQ ID NO: 10678 - DNA, 24 bp, Homo sapiens
gcttggatgaaagtggagagcaca

SEQ ID NO: 10679 - DNA, 23 bp, Homo sapiens
tgtgttcagaggatggcaaggtg

SEQ ID NO: 10680 - DNA, 25 bp, Homo sapiens
gcacccacatttcgtgagatccagt

SEQ ID NO: 10681 - DNA, 24 bp, Homo sapiens
cccctcagcccttgaatctggtat

SEQ ID NO: 10682 - DNA, 24 bp, Homo sapiens
gcccctcagcccttgaatctggta

SEQ ID NO: 10683 - DNA, 24 bp, Homo sapiens
cgcccctcagcccttgaatctggt

SEQ ID NO: 10684 - DNA, 24 bp, Homo sapiens
tttccttgcagttgaatctggtat

SEQ ID NO: 10685 - DNA, 24 bp, Homo sapiens
ttttccttgcagttgaatctggta

SEQ ID NO: 10686 - DNA, 24 bp, Homo sapiens
tttttccttgcagttgaatctggt

SEQ ID NO: 10687 - DNA, 25 bp, Homo sapiens
tctataactggttcacacgaatgtt

SEQ ID NO: 10688 - DNA, 25 bp, Homo sapiens
aagaacgcagaagttagaccaccat

SEQ ID NO: 10689 - DNA, 25 bp, Homo sapiens
cctctgtcatcacaaccaccagcat

SEQ ID NO: 10690 - DNA, 23 bp, Homo sapiens
agtccttcctcacactgccgcca

SEQ ID NO: 10691 - DNA, 25 bp, Homo sapiens
ttacaaactctcaactttcttccgt

SEQ ID NO: 10692 - DNA, 23 bp, Homo sapiens
aaattgcctctcccgccccaaag

SEQ ID NO: 10693 - DNA, 23 bp, Homo sapiens
tgcgctggacgatagaagtacag

SEQ ID NO: 10694 - DNA, 23 bp, Homo sapiens
gtagagtacaaatgcaggttgta

SEQ ID NO: 10695 - DNA, 25 bp, Homo sapiens
acctgcatgtgaagtctacagaacc

SEQ ID NO: 10696 - DNA, 25 bp, Homo sapiens
ggcatcactccaagcattactaatt

SEQ ID NO: 10697 - DNA, 25 bp, Homo sapiens
cccttggtggactttgtggaacttc

SEQ ID NO: 10698 - DNA, 23 bp, Homo sapiens
agctggtgatgaattctccctca

SEQ ID NO: 10699 - DNA, 24 bp, Homo sapiens
cgagtctgcctgtccttatgttat

SEQ ID NO: 10700 - DNA, 24 bp, Homo sapiens
acgagtctgcctgtccttatgtta

SEQ ID NO: 10701 - DNA, 24 bp, Homo sapiens
gacgagtctgcctgtccttatgtt

SEQ ID NO: 10702 - DNA, 24 bp, Homo sapiens
atgatgccaagtcagatatgtaca

SEQ ID NO: 10703 - DNA, 24 bp, Homo sapiens
tatgatgccaagtcagatatgtac

SEQ ID NO: 10704 - DNA, 24 bp, Homo sapiens
gtatgatgccaagtcagatatgta

SEQ ID NO: 10705 - DNA, 24 bp, Homo sapiens
gggctgctgtcttctttcacttgt

SEQ ID NO: 10706 - DNA, 25 bp, Homo sapiens
agctcattgagactacatcacaaca

SEQ ID NO: 10707 - DNA, 23 bp, Homo sapiens
ttactcacttaatgaggtctgct

SEQ ID NO: 10708 - DNA, 23 bp, Homo sapiens
gcatgaaccaaacccacttcgtt

SEQ ID NO: 10709 - DNA, 24 bp, Homo sapiens
actcttgctggtttctttgctgga

SEQ ID NO: 10710 - DNA, 25 bp, Homo sapiens
ccctacaacagccaaccttcccttt

SEQ ID NO: 10711 - DNA, 24 bp, Homo sapiens
actcttgctggtttctttgctgga

SEQ ID NO: 10712 - DNA, 23 bp, Homo sapiens
gcatgaaccaaacccacttcgtt

SEQ ID NO: 10713 - DNA, 23 bp, Homo sapiens
agccaaccttcccttttgcagtt

SEQ ID NO: 10714 - DNA, 24 bp, Homo sapiens
ggaagtgctctccgaccaggaaga

SEQ ID NO: 10715 - DNA, 24 bp, Homo sapiens
aaatggcttggctggtttgtctgc

SEQ ID NO: 10716 - DNA, 24 bp, Homo sapiens
gtcagacagaggcacagtaccacc

SEQ ID NO: 10717 - DNA, 25 bp, Homo sapiens
ggagtatgtggacgagtctgcctgt

SEQ ID NO: 10718 - DNA, 25 bp, Homo sapiens
gctctcgctgtgggattggatagtc

SEQ ID NO: 10719 - DNA, 24 bp, Homo sapiens
gtcagacagaggcacagtaccacc

SEQ ID NO: 10720 - DNA, 24 bp, Homo sapiens
gcgcccggacggtcctcagccctc

SEQ ID NO: 10721 - DNA, 24 bp, Homo sapiens
cgcgcccggacggtcctcagccct

SEQ ID NO: 10722 - DNA, 24 bp, Homo sapiens
ccgcgcccggacggtcctcagccc

SEQ ID NO: 10723 - DNA, 24 bp, Homo sapiens
atgctctgcttcctgaactgccac

SEQ ID NO: 10724 - DNA, 23 bp, Homo sapiens
agaccatcctcagcctccagcag

SEQ ID NO: 10725 - DNA, 24 bp, Homo sapiens
gacctgaacttccgcattgagagc

SEQ ID NO: 10726 - DNA, 24 bp, Homo sapiens
gggaggctgaggcaggagaatcgc

SEQ ID NO: 10727 - DNA, 24 bp, Homo sapiens
tgggaggctgaggcaggagaatcg

SEQ ID NO: 10728 - DNA, 24 bp, Homo sapiens
ttgggaggctgaggcaggagaatc

SEQ ID NO: 10729 - DNA, 24 bp, Homo sapiens
ccatcagcaagctggtgaggcagt

SEQ ID NO: 10730 - DNA, 24 bp, Homo sapiens
gccatcagcaagctggtgaggcag

SEQ ID NO: 10731 - DNA, 24 bp, Homo sapiens
ggccatcagcaagctggtgaggca

SEQ ID NO: 10732 - DNA, 23 bp, Homo sapiens
caatcctcgtgcctgagcctccc

SEQ ID NO: 10733 - DNA, 23 bp, Homo sapiens
ctaggctggtctcgaactcctgg

SEQ ID NO: 10734 - DNA, 25 bp, Homo sapiens
catgtgtgaaccaaatgttctgaat

SEQ ID NO: 10735 - DNA, 24 bp, Homo sapiens
aggctgtttgcttgctttggaggg

SEQ ID NO: 10736 - DNA, 25 bp, Homo sapiens
aaacctcccacccagttgagaaagt

SEQ ID NO: 10737 - DNA, 25 bp, Homo sapiens
actggaaagtggctgagtgtctact

SEQ ID NO: 10738 - DNA, 24 bp, Homo sapiens
ggtcatccattcgtgcctccaact

SEQ ID NO: 10739 - DNA, 23 bp, Homo sapiens
catccttgaacaccacgctgcct

SEQ ID NO: 10740 - DNA, 25 bp, Homo sapiens
attgaccctgaaactgacccttacg

SEQ ID NO: 10741 - DNA, 25 bp, Homo sapiens
gcaacaatctcgtcaacttgatcca

SEQ ID NO: 10742 - DNA, 23 bp, Homo sapiens
caccatctcagcagcagccactc

SEQ ID NO: 10743 - DNA, 25 bp, Homo sapiens
gaagtggacgacagtggacagcatt

SEQ ID NO: 10744 - DNA, 23 bp, Homo sapiens
catccttgaacaccacgctgcct

SEQ ID NO: 10745 - DNA, 24 bp, Homo sapiens
ggtcatccattcgtgcctccaact

SEQ ID NO: 10746 - DNA, 24 bp, Homo sapiens
acagcacaaagcacttcagccaga

SEQ ID NO: 10747 - DNA, 25 bp, Homo sapiens
tcatccattcgtgcctccaactaca

SEQ ID NO: 10748 - DNA, 23 bp, Homo sapiens
acaccacgctgccttcaactagt

SEQ ID NO: 10749 - DNA, 24 bp, Homo sapiens
ggtcatccattcgtgcctccaact

SEQ ID NO: 10750 - DNA, 23 bp, Homo sapiens
catccttgaacaccacgctgcct

SEQ ID NO: 10751 - DNA, 24 bp, Homo sapiens
acggctctagcagtgttaattggc

SEQ ID NO: 10752 - DNA, 24 bp, Homo sapiens
acttaccagaggtgcaaattgagc

SEQ ID NO: 10753 - DNA, 24 bp, Homo sapiens
gacttaccagaggtgcaaattgag

SEQ ID NO: 10754 - DNA, 24 bp, Homo sapiens
agacttaccagaggtgcaaattga

SEQ ID NO: 10755 - DNA, 24 bp, Homo sapiens
ggtaggcataggattggattcagc

SEQ ID NO: 10756 - DNA, 24 bp, Homo sapiens
gggtaggcataggattggattcag

SEQ ID NO: 10757 - DNA, 24 bp, Homo sapiens
cgggtaggcataggattggattca

SEQ ID NO: 10758 - DNA, 24 bp, Homo sapiens
tgcgttctctcttcggcgtctcta

SEQ ID NO: 10759 - DNA, 23 bp, Homo sapiens
aataaatacaagcagctccagct

SEQ ID NO: 10760 - DNA, 23 bp, Homo sapiens
ggggcaacaactacccacagatt

SEQ ID NO: 10761 - DNA, 24 bp, Homo sapiens
taatcctcctgcctcggcctccta

SEQ ID NO: 10762 - DNA, 24 bp, Homo sapiens
aaagagtgggacagggacaagcat

SEQ ID NO: 10763 - DNA, 23 bp, Homo sapiens
aagcaggaagagaagccacagcg

SEQ ID NO: 10764 - DNA, 24 bp, Homo sapiens
aaagagggctgctcaactgcaagg

SEQ ID NO: 10765 - DNA, 23 bp, Homo sapiens
tcaccgcttcctcctcgctcttc

SEQ ID NO: 10766 - DNA, 24 bp, Homo sapiens
ggtctgtctcctctagcctcctgc

SEQ ID NO: 10767 - DNA, 25 bp, Homo sapiens
gctctgtttctgcctggtcatcctg

SEQ ID NO: 10768 - DNA, 24 bp, Homo sapiens
atcctggaccggcaccctttcttg

SEQ ID NO: 10769 - DNA, 24 bp, Homo sapiens
gatcctggaccggcaccctttctt

SEQ ID NO: 10770 - DNA, 24 bp, Homo sapiens
agatcctggaccggcaccctttct

SEQ ID NO: 10771 - DNA, 24 bp, Homo sapiens
gactcaagccatcctcctgcctcg

SEQ ID NO: 10772 - DNA, 24 bp, Homo sapiens
aggatctcactatgttgcccaggc

SEQ ID NO: 10773 - DNA, 24 bp, Homo sapiens
agtgctgggattacaggcataagc

SEQ ID NO: 10774 - DNA, 24 bp, Homo sapiens
cttgtgaaggaatcagcatgggag

SEQ ID NO: 10775 - DNA, 24 bp, Homo sapiens
ccttgtgaaggaatcagcatggga

SEQ ID NO: 10776 - DNA, 24 bp, Homo sapiens
accttgtgaaggaatcagcatggg

SEQ ID NO: 10777 - DNA, 24 bp, Homo sapiens
tgtatgctggagtcaagattgcgg

SEQ ID NO: 10778 - DNA, 25 bp, Homo sapiens
acggataatggacatggtgagcaac

SEQ ID NO: 10779 - DNA, 23 bp, Homo sapiens
atgtatctcgtgcctgctgccat

SEQ ID NO: 10780 - DNA, 24 bp, Homo sapiens
gctgagtacagagcctctgagggt

SEQ ID NO: 10781 - DNA, 24 bp, Homo sapiens
tgctgagtacagagcctctgaggg

SEQ ID NO: 10782 - DNA, 24 bp, Homo sapiens
ttgctgagtacagagcctctgagg

SEQ ID NO: 10783 - DNA, 24 bp, Homo sapiens
gctggcagtgctgaagaaggagtc

SEQ ID NO: 10784 - DNA, 24 bp, Homo sapiens
aaacggttatggcgagatggtggg

SEQ ID NO: 10785 - DNA, 24 bp, Homo sapiens
tcagcagatccagggaatatcagc

SEQ ID NO: 10786 - DNA, 24 bp, Homo sapiens
tcctgaggatgctactcccgagcc

SEQ ID NO: 10787 - DNA, 24 bp, Homo sapiens
ctcctgaggatgctactcccgagc

SEQ ID NO: 10788 - DNA, 24 bp, Homo sapiens
actcctgaggatgctactcccgag

SEQ ID NO: 10789 - DNA, 24 bp, Homo sapiens
atgagtttctgaggatcagcactg

SEQ ID NO: 10790 - DNA, 24 bp, Homo sapiens
gatgagtttctgaggatcagcact

SEQ ID NO: 10791 - DNA, 24 bp, Homo sapiens
agatgagtttctgaggatcagcac

SEQ ID NO: 10792 - DNA, 24 bp, Homo sapiens
gtgcttcaacgatgtgactgccat

SEQ ID NO: 10793 - DNA, 24 bp, Homo sapiens
agtgcttcaacgatgtgactgcca

SEQ ID NO: 10794 - DNA, 24 bp, Homo sapiens
cagtgcttcaacgatgtgactgcc

SEQ ID NO: 10795 - DNA, 24 bp, Homo sapiens
ctgcgcaccatctctgtgatcctg

SEQ ID NO: 10796 - DNA, 24 bp, Homo sapiens
gtgatcctgttcctcaacaagcaa

SEQ ID NO: 10797 - DNA, 24 bp, Homo sapiens
tgtgatcctgttcctcaacaagca

SEQ ID NO: 10798 - DNA, 24 bp, Homo sapiens
ctgtgatcctgttcctcaacaagc

SEQ ID NO: 10799 - DNA, 23 bp, Homo sapiens
ggaggacaaccagaccaaccgcc

SEQ ID NO: 10800 - DNA, 25 bp, Homo sapiens
cgcaccatctctgtgatcctgttcc

SEQ ID NO: 10801 - DNA, 24 bp, Homo sapiens
ttgctcgctacactactcctgagg

SEQ ID NO: 10802 - DNA, 23 bp, Homo sapiens
tcgctgagaaagtccttgctggg

SEQ ID NO: 10803 - DNA, 25 bp, Homo sapiens
tgtgatcctgttcctcaacaagcaa

SEQ ID NO: 10804 - DNA, 25 bp, Homo sapiens
gactactttccagaatttgctcgct

SEQ ID NO: 10805 - DNA, 23 bp, Homo sapiens
tggagatgggcgtcactactgct

SEQ ID NO: 10806 - DNA, 23 bp, Homo sapiens
gtggacactgagaacatccgccg

SEQ ID NO: 10807 - DNA, 24 bp, Homo sapiens
cgactgccgtgacatcattcagcg

SEQ ID NO: 10808 - DNA, 23 bp, Homo sapiens
cttcaagagcatctggaacaaca

SEQ ID NO: 10809 - DNA, 23 bp, Homo sapiens
ggaggacaaccagaccaaccgcc

SEQ ID NO: 10810 - DNA, 25 bp, Homo sapiens
agtgcttcaacgatgtgactgccat

SEQ ID NO: 10811 - DNA, 25 bp, Homo sapiens
ggcgtcactactgctaccctcattt

SEQ ID NO: 10812 - DNA, 23 bp, Homo sapiens
gtggacactgagaacatccgccg

SEQ ID NO: 10813 - DNA, 24 bp, Homo sapiens
cgactgccgtgacatcattcagcg

SEQ ID NO: 10814 - DNA, 24 bp, Homo sapiens
ctctctctcaggtaagagcccact

SEQ ID NO: 10815 - DNA, 24 bp, Homo sapiens
actctctctcaggtaagagcccac

SEQ ID NO: 10816 - DNA, 24 bp, Homo sapiens
aactctctctcaggtaagagccca

SEQ ID NO: 10817 - DNA, 24 bp, Homo sapiens
atgccatttgcgtgagtctgggtg

SEQ ID NO: 10818 - DNA, 24 bp, Homo sapiens
aatgccatttgcgtgagtctgggt

SEQ ID NO: 10819 - DNA, 24 bp, Homo sapiens
caatgccatttgcgtgagtctggg

SEQ ID NO: 10820 - DNA, 24 bp, Homo sapiens
gtctgaggggcggacggaggcggc

SEQ ID NO: 10821 - DNA, 24 bp, Homo sapiens
ggttcaagcgattctcctgcctcc

SEQ ID NO: 10822 - DNA, 24 bp, Homo sapiens
ggattataggcacgcaccaccacg

SEQ ID NO: 10823 - DNA, 24 bp, Homo sapiens
ttgaactcctgaccttgtgatcca

SEQ ID NO: 10824 - DNA, 24 bp, Homo sapiens
ggaggctgaggaaggagaatcgct

SEQ ID NO: 10825 - DNA, 24 bp, Homo sapiens
ctggcgacagagcgagactccgtc

SEQ ID NO: 10826 - DNA, 24 bp, Homo sapiens
cagcagttgcagtgagccgagatc

SEQ ID NO: 10827 - DNA, 24 bp, Homo sapiens
agcgcttctagaaatgctgagccg

SEQ ID NO: 10828 - DNA, 24 bp, Homo sapiens
cagcgcttctagaaatgctgagcc

SEQ ID NO: 10829 - DNA, 24 bp, Homo sapiens
gcagcgcttctagaaatgctgagc

SEQ ID NO: 10830 - DNA, 24 bp, Homo sapiens
aggagaaggaggaactaatcagca

SEQ ID NO: 10831 - DNA, 24 bp, Homo sapiens
gcttactcaggcacaggcagaaca

SEQ ID NO: 10832 - DNA, 24 bp, Homo sapiens
acagcaggtggtccgagagaaaga

SEQ ID NO: 10833 - DNA, 23 bp, Homo sapiens
ggattctcctgcctcagtctcca

SEQ ID NO: 10834 - DNA, 23 bp, Homo sapiens
cttactgcaacctccgcctccca

SEQ ID NO: 10835 - DNA, 23 bp, Homo sapiens
ctaggctggagtgcagtggcacg

SEQ ID NO: 10836 - DNA, 24 bp, Homo sapiens
ggttcaagcgattctcctgcctca

SEQ ID NO: 10837 - DNA, 24 bp, Homo sapiens
gcaatggcatgatctcggctcact

SEQ ID NO: 10838 - DNA, 23 bp, Homo sapiens
gctggtcttgaactcctgggctc

SEQ ID NO: 10839 - DNA, 25 bp, Homo sapiens
agcgttgagattacaagcgtgagcc

SEQ ID NO: 10840 - DNA, 24 bp, Homo sapiens
tcttcctgccgctgattcctcaca

SEQ ID NO: 10841 - DNA, 24 bp, Homo sapiens
gcacctcctgcctcttcctcaagc

SEQ ID NO: 10842 - DNA, 24 bp, Homo sapiens
agcacctcctgcctcttcctcaag

SEQ ID NO: 10843 - DNA, 24 bp, Homo sapiens
cagcacctcctgcctcttcctcaa

SEQ ID NO: 10844 - DNA, 24 bp, Homo sapiens
gccgtgctgtcctccgtgagcacc

SEQ ID NO: 10845 - DNA, 24 bp, Homo sapiens
cgccgtgctgtcctccgtgagcac

SEQ ID NO: 10846 - DNA, 24 bp, Homo sapiens
tcgccgtgctgtcctccgtgagca

SEQ ID NO: 10847 - DNA, 23 bp, Homo sapiens
acttcctcctggtgatgctcagc

SEQ ID NO: 10848 - DNA, 24 bp, Homo sapiens
caaacaaccttgacctcctgctca

SEQ ID NO: 10849 - DNA, 24 bp, Homo sapiens
gcaaaccatcaccaatgagaaccc

SEQ ID NO: 10850 - DNA, 24 bp, Homo sapiens
cttctgctcaaggtgcttctgcca

SEQ ID NO: 10851 - DNA, 25 bp, Homo sapiens
tggaagaaacaaggaaggaaacggc

SEQ ID NO: 10852 - DNA, 25 bp, Homo sapiens
tgccatgatgaagattggaacaagg

SEQ ID NO: 10853 - DNA, 24 bp, Homo sapiens
gcagcggagcatcgtcattcttca

SEQ ID NO: 10854 - DNA, 24 bp, Homo sapiens
gccacctcctccaactcaacaaca

SEQ ID NO: 10855 - DNA, 24 bp, Homo sapiens
aatatcaagacacctgccgagcgt

SEQ ID NO: 10856 - DNA, 24 bp, Homo sapiens
tatcaagacacctgccgagcgtct

SEQ ID NO: 10857 - DNA, 24 bp, Homo sapiens
atatcaagacacctgccgagcgtc

SEQ ID NO: 10858 - DNA, 24 bp, Homo sapiens
atatcaagacacctgccgagcgtc

SEQ ID NO: 10859 - DNA, 24 bp, Homo sapiens
tgataatctcaagacacctcctga

SEQ ID NO: 10860 - DNA, 24 bp, Homo sapiens
ctcactccccttccaccctcagcg

SEQ ID NO: 10861 - DNA, 24 bp, Homo sapiens
ccaccctcagcggatgataatctc

SEQ ID NO: 10862 - DNA, 24 bp, Homo sapiens
gagcctcaagacacctcccgagtg

SEQ ID NO: 10863 - DNA, 24 bp, Homo sapiens
gccacctcctccaactcaacaaca

SEQ ID NO: 10864 - DNA, 24 bp, Homo sapiens
aaaccacgcaaacccaagaggcag

SEQ ID NO: 10865 - DNA, 24 bp, Homo sapiens
aagaggcggaggttgagctgagaa

SEQ ID NO: 10866 - DNA, 24 bp, Homo sapiens
ccccaagaggcggagggattaccc

SEQ ID NO: 10867 - DNA, 24 bp, Homo sapiens
tatcaagacacctgccgagcgtct

SEQ ID NO: 10868 - DNA, 24 bp, Homo sapiens
atatcaagacacctgccgagcgtc

SEQ ID NO: 10869 - DNA, 24 bp, Homo sapiens
aatatcaagacacctgccgagcgt

SEQ ID NO: 10870 - DNA, 24 bp, Homo sapiens
agcggatgataatctcaagacacc

SEQ ID NO: 10871 - DNA, 24 bp, Homo sapiens
gcggatgataatctcaaggagtgt

SEQ ID NO: 10872 - DNA, 24 bp, Homo sapiens
cctcagcggatgataatctcaagc

SEQ ID NO: 10873 - DNA, 24 bp, Homo sapiens
acctgagctcgctggcctcctccc

SEQ ID NO: 10874 - DNA, 24 bp, Homo sapiens
tacctgagctcgctggcctcctcc

SEQ ID NO: 10875 - DNA, 24 bp, Homo sapiens
atacctgagctcgctggcctcctc

SEQ ID NO: 10876 - DNA, 24 bp, Homo sapiens
tgaagctctctatcgtcctgaccc

SEQ ID NO: 10877 - DNA, 24 bp, Homo sapiens
ccgcagcaggtatgatctcgtgaa

SEQ ID NO: 10878 - DNA, 24 bp, Homo sapiens
cctcacagtcatggatctggaagc

SEQ ID NO: 10879 - DNA, 24 bp, Homo sapiens
atgcccatgcgagtacctgaggaa

SEQ ID NO: 10880 - DNA, 24 bp, Homo sapiens
gcccttgagcagttcccaggtctc

SEQ ID NO: 10881 - DNA, 24 bp, Homo sapiens
ggaatcattgctggcatggtaacc

SEQ ID NO: 10882 - DNA, 24 bp, Homo sapiens
gccctgcccaggcattgacaagct

SEQ ID NO: 10883 - DNA, 24 bp, Homo sapiens
tgccctgcccaggcattgacaagc

SEQ ID NO: 10884 - DNA, 24 bp, Homo sapiens
gtgccctgcccaggcattgacaag

SEQ ID NO: 10885 - DNA, 24 bp, Homo sapiens
cctcctgtgaggcgtgtgcgcaca

SEQ ID NO: 10886 - DNA, 24 bp, Homo sapiens
acctcctgtgaggcgtgtgcgcac

SEQ ID NO: 10887 - DNA, 24 bp, Homo sapiens
gacctcctgtgaggcgtgtgcgca

SEQ ID NO: 10888 - DNA, 24 bp, Homo sapiens
agattgtgtttgaatctttattaa

SEQ ID NO: 10889 - DNA, 24 bp, Homo sapiens
cagattgtgtttgaatctttatta

SEQ ID NO: 10890 - DNA, 24 bp, Homo sapiens
acagattgtgtttgaatctttatt

SEQ ID NO: 10891 - DNA, 24 bp, Homo sapiens
tgggattgcaggtacacaccacta

SEQ ID NO: 10892 - DNA, 24 bp, Homo sapiens
ctgggattgcaggtacacaccact

SEQ ID NO: 10893 - DNA, 24 bp, Homo sapiens
gctgggattgcaggtacacaccac

SEQ ID NO: 10894 - DNA, 24 bp, Homo sapiens
acagtgtcttgctcggtcacctag

SEQ ID NO: 10895 - DNA, 24 bp, Homo sapiens
ctcccaactcccaggctcaaatga

SEQ ID NO: 10896 - DNA, 23 bp, Homo sapiens
cccaaagtgctaggaccacaggc

SEQ ID NO: 10897 - DNA, 24 bp, Homo sapiens
cagagctggagctggatctaccat

SEQ ID NO: 10898 - DNA, 24 bp, Homo sapiens
acagagctggagctggatctacca

SEQ ID NO: 10899 - DNA, 24 bp, Homo sapiens
cacagagctggagctggatctacc

SEQ ID NO: 10900 - DNA, 24 bp, Homo sapiens
caaggatccgagtgagtacatcaa

SEQ ID NO: 10901 - DNA, 24 bp, Homo sapiens
acaaggatccgagtgagtacatca

SEQ ID NO: 10902 - DNA, 24 bp, Homo sapiens
tacaaggatccgagtgagtacatc

SEQ ID NO: 10903 - DNA, 24 bp, Homo sapiens
gttattaaaagagccacctaagct

SEQ ID NO: 10904 - DNA, 24 bp, Homo sapiens
tgttattaaaagagccacctaagc

SEQ ID NO: 10905 - DNA, 24 bp, Homo sapiens
ttgttattaaaagagccacctaag

SEQ ID NO: 10906 - DNA, 24 bp, Homo sapiens
tcctcctacctgagcctcctgagt

SEQ ID NO: 10907 - DNA, 24 bp, Homo sapiens
cgtggctgagactacaggtgcttg

SEQ ID NO: 10908 - DNA, 24 bp, Homo sapiens
caaggctggagtgtagtagtgcta

SEQ ID NO: 10909 - DNA, 24 bp, Homo sapiens
gcctcccagagtgctgagattaca

SEQ ID NO: 10910 - DNA, 24 bp, Homo sapiens
cgcctcgactcctgacatcaagtg

SEQ ID NO: 10911 - DNA, 24 bp, Homo sapiens
cccaccaccacacgaggctaattt

SEQ ID NO: 10912 - DNA, 24 bp, Homo sapiens
actacaggtgcttgccactatgcc

SEQ ID NO: 10913 - DNA, 24 bp, Homo sapiens
ggctggagtgtagtagtgctatca

SEQ ID NO: 10914 - DNA, 24 bp, Homo sapiens
atcctcccatctcaacctcccacg

SEQ ID NO: 10915 - DNA, 24 bp, Homo sapiens
ccagtcagcctctacagaccaagc

SEQ ID NO: 10916 - DNA, 24 bp, Homo sapiens
gcagtctccgcagatgaggctact

SEQ ID NO: 10917 - DNA, 24 bp, Homo sapiens
ccacaggcacagctccatcgttac

SEQ ID NO: 10918 - DNA, 24 bp, Homo sapiens
cggccacctcggcctccagctaaa

SEQ ID NO: 10919 - DNA, 24 bp, Homo sapiens
gcggccacctcggcctccagctaa

SEQ ID NO: 10920 - DNA, 24 bp, Homo sapiens
ggcggccacctcggcctccagcta

SEQ ID NO: 10921 - DNA, 24 bp, Homo sapiens
cggccacctcggcctccagctaaa

SEQ ID NO: 10922 - DNA, 24 bp, Homo sapiens
gcggccacctcggcctccagctaa

SEQ ID NO: 10923 - DNA, 24 bp, Homo sapiens
ggcggccacctcggcctccagcta

SEQ ID NO: 10924 - DNA, 25 bp, Homo sapiens
tgtagaccggagctgttcctattgg

SEQ ID NO: 10925 - DNA, 23 bp, Homo sapiens
gaaatcacccgtcttctgcgtcg

SEQ ID NO: 10926 - DNA, 23 bp, Homo sapiens
actccctagtgagatgaaccctc

SEQ ID NO: 10927 - DNA, 24 bp, Homo sapiens
gtagcagccctgcgtttcagacgg

SEQ ID NO: 10928 - DNA, 24 bp, Homo sapiens
actttcattgacggacccagccat

SEQ ID NO: 10929 - DNA, 24 bp, Homo sapiens
gtttgctactggaaaaagaggaaa

SEQ ID NO: 10930 - DNA, 24 bp, Homo sapiens
acctcccaaagtgctgggattaca

SEQ ID NO: 10931 - DNA, 24 bp, Homo sapiens
gacctcccaaagtgctgggattac

SEQ ID NO: 10932 - DNA, 24 bp, Homo sapiens
cgacctcccaaagtgctgggatta

SEQ ID NO: 10933 - DNA, 24 bp, Homo sapiens
ttcttgccatggagcctccaaagg

SEQ ID NO: 10934 - DNA, 24 bp, Homo sapiens
gttcttgccatggagcctccaaag

SEQ ID NO: 10935 - DNA, 24 bp, Homo sapiens
ggttcttgccatggagcctccaaa

SEQ ID NO: 10936 - DNA, 23 bp, Homo sapiens
tcaagcaatccacccgcctcagc

SEQ ID NO: 10937 - DNA, 24 bp, Homo sapiens
aagtgctgagattacaggcgtgag

SEQ ID NO: 10938 - DNA, 23 bp, Homo sapiens
ttgcccaggctggtctcgaactc

SEQ ID NO: 10939 - DNA, 24 bp, Homo sapiens
gggaggccgaggtgggtggaacac

SEQ ID NO: 10940 - DNA, 24 bp, Homo sapiens
tgggaggccgaggtgggtggaaca

SEQ ID NO: 10941 - DNA, 24 bp, Homo sapiens
ttgggaggccgaggtgggtggaac

SEQ ID NO: 10942 - DNA, 23 bp, Homo sapiens
ggagtgccacctgctcacacacg

SEQ ID NO: 10943 - DNA, 23 bp, Homo sapiens
ccgcctgctcacacatgcccatg

SEQ ID NO: 10944 - DNA, 23 bp, Homo sapiens
atgtggagtgcccgcctgctcat

SEQ ID NO: 10945 - DNA, 24 bp, Homo sapiens
catgtggaaatggtccagcctgca

SEQ ID NO: 10946 - DNA, 24 bp, Homo sapiens
gcatgtggaaatggtccagcctgc

SEQ ID NO: 10947 - DNA, 24 bp, Homo sapiens
agcatgtggaaatggtccagcctg

SEQ ID NO: 10948 - DNA, 24 bp, Homo sapiens
ttattttatagaaagtggagaccc

SEQ ID NO: 10949 - DNA, 24 bp, Homo sapiens
gttattttatagaaagtggagacc

SEQ ID NO: 10950 - DNA, 24 bp, Homo sapiens
tgttattttatagaaagtggagac

SEQ ID NO: 10951 - DNA, 24 bp, Homo sapiens
gccctgcctggaatggctacaccc

SEQ ID NO: 10952 - DNA, 24 bp, Homo sapiens
agccctgcctggaatggctacacc

SEQ ID NO: 10953 - DNA, 24 bp, Homo sapiens
cagccctgcctggaatggctacac

SEQ ID NO: 10954 - DNA, 24 bp, Homo sapiens
ccaccacccgggtaaggcaggcag

SEQ ID NO: 10955 - DNA, 24 bp, Homo sapiens
gccaccacccgggtaaggcaggca

SEQ ID NO: 10956 - DNA, 24 bp, Homo sapiens
cgccaccacccgggtaaggcaggc

SEQ ID NO: 10957 - DNA, 24 bp, Homo sapiens
cctgtaaccagaatgggttgaatg

SEQ ID NO: 10958 - DNA, 24 bp, Homo sapiens
acctgtaaccagaatgggttgaat

SEQ ID NO: 10959 - DNA, 24 bp, Homo sapiens
cacctgtaaccagaatgggttgaa

SEQ ID NO: 10960 - DNA, 24 bp, Homo sapiens
aggtcagctcggtgagtacactct

SEQ ID NO: 10961 - DNA, 24 bp, Homo sapiens
gaggtcagctcggtgagtacactc

SEQ ID NO: 10962 - DNA, 24 bp, Homo sapiens
cgaggtcagctcggtgagtacact

SEQ ID NO: 10963 - DNA, 24 bp, Homo sapiens
tctcgttttagttagtcagtgata

SEQ ID NO: 10964 - DNA, 24 bp, Homo sapiens
ttctcgttttagttagtcagtgat

SEQ ID NO: 10965 - DNA, 24 bp, Homo sapiens
tttctcgttttagttagtcagtga

SEQ ID NO: 10966 - DNA, 24 bp, Homo sapiens
ggaagatgaaggggaagaactcat

SEQ ID NO: 10967 - DNA, 24 bp, Homo sapiens
cggaagatgaaggggaagaactca

SEQ ID NO: 10968 - DNA, 24 bp, Homo sapiens
tcggaagatgaaggggaagaactc

SEQ ID NO: 10969 - DNA, 24 bp, Homo sapiens
cagttcctgagccctgtaatcgtg

SEQ ID NO: 10970 - DNA, 24 bp, Homo sapiens
acagttcctgagccctgtaatcgt

SEQ ID NO: 10971 - DNA, 24 bp, Homo sapiens
cacagttcctgagccctgtaatcg

SEQ ID NO: 10972 - DNA, 24 bp, Homo sapiens
cgacaaccaagaaggggaacacgg

SEQ ID NO: 10973 - DNA, 24 bp, Homo sapiens
acgacaaccaagaaggggaacacg

SEQ ID NO: 10974 - DNA, 24 bp, Homo sapiens
aacgacaaccaagaaggggaacac

SEQ ID NO: 10975 - DNA, 24 bp, Homo sapiens
ctactttttaggttttggctgtcg

SEQ ID NO: 10976 - DNA, 24 bp, Homo sapiens
cctactttttaggttttggctgtc

SEQ ID NO: 10977 - DNA, 24 bp, Homo sapiens
ccctactttttaggttttggctgt

SEQ ID NO: 10978 - DNA, 24 bp, Homo sapiens
aaacgcaaacatggagaatctgta

SEQ ID NO: 10979 - DNA, 24 bp, Homo sapiens
aaaacgcaaacatggagaatctgt

SEQ ID NO: 10980 - DNA, 24 bp, Homo sapiens
caaaacgcaaacatggagaatctg

SEQ ID NO: 10981 - DNA, 23 bp, Homo sapiens
gtgaggaggcgaggatgtggact

SEQ ID NO: 10982 - DNA, 24 bp, Homo sapiens
tcagtgacgacgaggagaccatct

SEQ ID NO: 10983 - DNA, 23 bp, Homo sapiens
ccagtggagaatgagaggcaggc

SEQ ID NO: 10984 - DNA, 24 bp, Homo sapiens
cacactctgccaggcttcaatcct

SEQ ID NO: 10985 - DNA, 24 bp, Homo sapiens
acacactctgccaggcttcaatcc

SEQ ID NO: 10986 - DNA, 24 bp, Homo sapiens
cacacactctgccaggcttcaatc

SEQ ID NO: 10987 - DNA, 23 bp, Homo sapiens
aggcgggattccagggatgttga

SEQ ID NO: 10988 - DNA, 25 bp, Homo sapiens
caccgagacctcagacaacatcagc

SEQ ID NO: 10989 - DNA, 23 bp, Homo sapiens
atgagaggaagtcgccacaacgg

SEQ ID NO: 10990 - DNA, 23 bp, Homo sapiens
gccacgaacgctgtcccctctgt

SEQ ID NO: 10991 - DNA, 23 bp, Homo sapiens
gtgtcgcctcggggatcgctgag

SEQ ID NO: 10992 - DNA, 23 bp, Homo sapiens
cggaactgccttcgccttcccgc

SEQ ID NO: 10993 - DNA, 24 bp, Homo sapiens
tcagtgacgacgaggagaccatct

SEQ ID NO: 10994 - DNA, 24 bp, Homo sapiens
agtagcagcccaaggagacacaca

SEQ ID NO: 10995 - DNA, 23 bp, Homo sapiens
cctgctgggctcacttgactgtc

SEQ ID NO: 10996 - DNA, 25 bp, Homo sapiens
caccgagacctcagacaacatcagc

SEQ ID NO: 10997 - DNA, 23 bp, Homo sapiens
atgagaggaagtcgccacaacgg

SEQ ID NO: 10998 - DNA, 23 bp, Homo sapiens
catcacctgccgcctggtcaagc

SEQ ID NO: 10999 - DNA, 23 bp, Homo sapiens
gcccctgctgaaagaccggcatg

SEQ ID NO: 11000 - DNA, 23 bp, Homo sapiens
ctgctcctcctcaagcccccaag

SEQ ID NO: 11001 - DNA, 24 bp, Homo sapiens
gtcaacgcccagtcacagaaaggt

SEQ ID NO: 11002 - DNA, 25 bp, Homo sapiens
accagaatgtagccacagaagacgg

SEQ ID NO: 11003 - DNA, 24 bp, Homo sapiens
gcacctcatcaactacggcaccaa

SEQ ID NO: 11004 - DNA, 24 bp, Homo sapiens
gcacctcatcaactacggcaccaa

SEQ ID NO: 11005 - DNA, 24 bp, Homo sapiens
gcggctcactacgagaacctcaac

SEQ ID NO: 11006 - DNA, 23 bp, Homo sapiens
tcacaccacagaacggcatcacg

SEQ ID NO: 11007 - DNA, 24 bp, Homo sapiens
gcacctcatcaactacggcaccaa

SEQ ID NO: 11008 - DNA, 23 bp, Homo sapiens
ctgcagcagggccatgagaacgt

SEQ ID NO: 11009 - DNA, 23 bp, Homo sapiens
gtgctgctgcagaacgaccccaa

SEQ ID NO: 11010 - DNA, 24 bp, Homo sapiens
gcggctcactacgagaacctcaac

SEQ ID NO: 11011 - DNA, 23 bp, Homo sapiens
tcacaccacagaacggcatcacg

SEQ ID NO: 11012 - DNA, 25 bp, Homo sapiens
ccaagaccaaggacgaattgacacc

SEQ ID NO: 11013 - DNA, 24 bp, Homo sapiens
gcacctcatcaactacggcaccaa

SEQ ID NO: 11014 - DNA, 25 bp, Homo sapiens
accagaatgtagccacagaagacgg

SEQ ID NO: 11015 - DNA, 25 bp, Homo sapiens
acatggcagcacaagagaaccactt

SEQ ID NO: 11016 - DNA, 24 bp, Homo sapiens
tcacaccacaggacgaattgacac

SEQ ID NO: 11017 - DNA, 24 bp, Homo sapiens
ttcacaccacaggacgaattgaca

SEQ ID NO: 11018 - DNA, 24 bp, Homo sapiens
tttcacaccacaggacgaattgac

SEQ ID NO: 11019 - DNA, 25 bp, Homo sapiens
ggaaaataacgccaaccccaacctg

SEQ ID NO: 11020 - DNA, 23 bp, Homo sapiens
gctcgcatcggccacacaaacat

SEQ ID NO: 11021 - DNA, 23 bp, Homo sapiens
ccgtgagggccatgtggaaacag

SEQ ID NO: 11022 - DNA, 24 bp, Homo sapiens
aacatggtgaagctcctgctggaa

SEQ ID NO: 11023 - DNA, 25 bp, Homo sapiens
ccagaacaaagccaaagtcaatgcc

SEQ ID NO: 11024 - DNA, 23 bp, Homo sapiens
tcccatcgtgaagaacctcctgc

SEQ ID NO: 11025 - DNA, 23 bp, Homo sapiens
ccaagcagaaccaggtggaggtg

SEQ ID NO: 11026 - DNA, 24 bp, Homo sapiens
tggctctgctgctctcgaaacaag

SEQ ID NO: 11027 - DNA, 23 bp, Homo sapiens
gagtcggtgcaaggtgtgacgcc

SEQ ID NO: 11028 - DNA, 24 bp, Homo sapiens
gccctgcctggagcggactcactc

SEQ ID NO: 11029 - DNA, 24 bp, Homo sapiens
agccctgcctggagcggactcact

SEQ ID NO: 11030 - DNA, 24 bp, Homo sapiens
cagccctgcctggagcggactcac

SEQ ID NO: 11031 - DNA, 23 bp, Homo sapiens
gcagcaccaggcagatgtcaatg

SEQ ID NO: 11032 - DNA, 24 bp, Homo sapiens
agacatcgtgactctgcttctgaa

SEQ ID NO: 11033 - DNA, 23 bp, Homo sapiens
gctcggatggaaccacacctctg

SEQ ID NO: 11034 - DNA, 24 bp, Homo sapiens
ctccatctggtagcacaagaaggc

SEQ ID NO: 11035 - DNA, 23 bp, Homo sapiens
agatggtggctctgctgctctcg

SEQ ID NO: 11036 - DNA, 23 bp, Homo sapiens
ccaagcagaaccaggtggaggtg

SEQ ID NO: 11037 - DNA, 23 bp, Homo sapiens
tcaaacacggcgtcatggtggac

SEQ ID NO: 11038 - DNA, 24 bp, Homo sapiens
ctccatctggtagcacaagaaggc

SEQ ID NO: 11039 - DNA, 23 bp, Homo sapiens
agatggtggctctgctgctctcg

SEQ ID NO: 11040 - DNA, 23 bp, Homo sapiens
tgctcaaggtcgtcacggatgaa

SEQ ID NO: 11041 - DNA, 25 bp, Homo sapiens
tcctggatgtctcggaagatgaagg

SEQ ID NO: 11042 - DNA, 24 bp, Homo sapiens
tcaggtcagaagagcaggagcagg

SEQ ID NO: 11043 - DNA, 24 bp, Homo sapiens
agacatcgtgactctgcttctgaa

SEQ ID NO: 11044 - DNA, 23 bp, Homo sapiens
gcagcaccaggcagatgtcaatg

SEQ ID NO: 11045 - DNA, 24 bp, Homo sapiens
ctccatctggtagcacaagaaggc

SEQ ID NO: 11046 - DNA, 25 bp, Homo sapiens
tcctggatgtctcggaagatgaagg

SEQ ID NO: 11047 - DNA, 23 bp, Homo sapiens
aggcgggattccagggatgttga

SEQ ID NO: 11048 - DNA, 24 bp, Homo sapiens
tcaggtcagaagagcaggagcagg

SEQ ID NO: 11049 - DNA, 23 bp, Homo sapiens
tgctcaaggtcgtcacggatgaa

SEQ ID NO: 11050 - DNA, 23 bp, Homo sapiens
gctcggatggaaccacacctctg

SEQ ID NO: 11051 - DNA, 23 bp, Homo sapiens
gcagcaccaggcagatgtcaatg

SEQ ID NO: 11052 - DNA, 24 bp, Homo sapiens
tcaggtcagaagagcaggagcagg

SEQ ID NO: 11053 - DNA, 25 bp, Homo sapiens
caccgagacctcagacaacatcagc

SEQ ID NO: 11054 - DNA, 23 bp, Homo sapiens
atgagaggaagtcgccacaacgg

SEQ ID NO: 11055 - DNA, 25 bp, Homo sapiens
caccgagacctcagacaacatcagc

SEQ ID NO: 11056 - DNA, 23 bp, Homo sapiens
gaggactccctcatccccagcag

SEQ ID NO: 11057 - DNA, 23 bp, Homo sapiens
atgagaggaagtcgccacaacgg

SEQ ID NO: 11058 - DNA, 23 bp, Homo sapiens
catcacctgccgcctggtcaagc

SEQ ID NO: 11059 - DNA, 24 bp, Homo sapiens
agttcctgagccctgtaatcgtgg

SEQ ID NO: 11060 - DNA, 23 bp, Homo sapiens
atgagaggaagtcgccacaacgg

SEQ ID NO: 11061 - DNA, 23 bp, Homo sapiens
catcacctgccgcctggtcaagc

SEQ ID NO: 11062 - DNA, 23 bp, Homo sapiens
cagcaggatcatagcactggggc

SEQ ID NO: 11063 - DNA, 23 bp, Homo sapiens
cctcaacgggatggacgaagagc

SEQ ID NO: 11064 - DNA, 23 bp, Homo sapiens
tgccgaatcatcaccaccgactt

SEQ ID NO: 11065 - DNA, 23 bp, Homo sapiens
gctctgccaggactacgacacca

SEQ ID NO: 11066 - DNA, 23 bp, Homo sapiens
gctctgccaggactacgacacca

SEQ ID NO: 11067 - DNA, 23 bp, Homo sapiens
atcaccaccgacttcccgctgta

SEQ ID NO: 11068 - DNA, 23 bp, Homo sapiens
cggagaatgccgtcaccaagaga

SEQ ID NO: 11069 - DNA, 24 bp, Homo sapiens
ggaagacataacaggaaccaccaa

SEQ ID NO: 11070 - DNA, 25 bp, Homo sapiens
cgccaacttcaccaccaatgtctct

SEQ ID NO: 11071 - DNA, 23 bp, Homo sapiens
tcggactgctgaggctgtgaact

SEQ ID NO: 11072 - DNA, 23 bp, Homo sapiens
tcggactgctgaggctgtgaact

SEQ ID NO: 11073 - DNA, 25 bp, Homo sapiens
cagcatgagaacttcgtggaggtgg

SEQ ID NO: 11074 - DNA, 24 bp, Homo sapiens
cgctgctactgcatgacagatgat

SEQ ID NO: 11075 - DNA, 25 bp, Homo sapiens
caaggcgatgaagtacgaggacacc

SEQ ID NO: 11076 - DNA, 25 bp, Homo sapiens
attctctgccacctgaacatcacca

SEQ ID NO: 11077 - DNA, 25 bp, Homo sapiens
tggagccgaagataggagaaggacc

SEQ ID NO: 11078 - DNA, 23 bp, Homo sapiens
cagagcattgaccgtggcgagat

SEQ ID NO: 11079 - DNA, 23 bp, Homo sapiens
agagccgcaacttgaagccagac

SEQ ID NO: 11080 - DNA, 23 bp, Homo sapiens
cacgccttctctggtcactgctg

SEQ ID NO: 11081 - DNA, 25 bp, Homo sapiens
cagagcaggcagagatgaagatggc

SEQ ID NO: 11082 - DNA, 25 bp, Homo sapiens
tcagtgagtccacaccaggttctct

SEQ ID NO: 11083 - DNA, 25 bp, Homo sapiens
tggagccgaagataggagaaggacc

SEQ ID NO: 11084 - DNA, 23 bp, Homo sapiens
ccaggagcacgaggaggtggagc

SEQ ID NO: 11085 - DNA, 23 bp, Homo sapiens
ctctccttggagtagcctctcgg

SEQ ID NO: 11086 - DNA, 24 bp, Homo sapiens
ggctgacggcatgacctctgtaag

SEQ ID NO: 11087 - DNA, 24 bp, Homo sapiens
ggccgggcgcggtggcgcacacct

SEQ ID NO: 11088 - DNA, 24 bp, Homo sapiens
gggccgggcgcggtggcgcacacc

SEQ ID NO: 11089 - DNA, 24 bp, Homo sapiens
ggggccgggcgcggtggcgcacac

SEQ ID NO: 11090 - DNA, 24 bp, Homo sapiens
agaggcgctcggtgagcctggggc

SEQ ID NO: 11091 - DNA, 24 bp, Homo sapiens
gagaggcgctcggtgagcctgggg

SEQ ID NO: 11092 - DNA, 24 bp, Homo sapiens
ggagaggcgctcggtgagcctggg

SEQ ID NO: 11093 - DNA, 24 bp, Homo sapiens
gccctgcccaggctccatcctgag

SEQ ID NO: 11094 - DNA, 24 bp, Homo sapiens
tgccctgcccaggctccatcctga

SEQ ID NO: 11095 - DNA, 24 bp, Homo sapiens
ctgccctgcccaggctccatcctg

SEQ ID NO: 11096 - DNA, 24 bp, Homo sapiens
tctccgactcatcctctctgcgcc

SEQ ID NO: 11097 - DNA, 24 bp, Homo sapiens
ttctccgactcatcctctctgcgc

SEQ ID NO: 11098 - DNA, 24 bp, Homo sapiens
cttctccgactcatcctctctgcg

SEQ ID NO: 11099 - DNA, 24 bp, Homo sapiens
gccactttcagcccactcagacag

SEQ ID NO: 11100 - DNA, 24 bp, Homo sapiens
actggcttctccgactcatcctct

SEQ ID NO: 11101 - DNA, 24 bp, Homo sapiens
ccttcatccaacacagccagaacc

SEQ ID NO: 11102 - DNA, 24 bp, Homo sapiens
ccagatgccacggatgaagaggtc

SEQ ID NO: 11103 - DNA, 25 bp, Homo sapiens
aaacaagacgactgggatgtcacag

SEQ ID NO: 11104 - DNA, 23 bp, Homo sapiens
cccaagcctcctctgcctggcat

SEQ ID NO: 11105 - DNA, 23 bp, Homo sapiens
ggcgggtcaccagtctacagtct

SEQ ID NO: 11106 - DNA, 23 bp, Homo sapiens
ctccgttgcctccttagcctcct

SEQ ID NO: 11107 - DNA, 25 bp, Homo sapiens
agtgatgcctttctcgtgtctgtga

SEQ ID NO: 11108 - DNA, 25 bp, Homo sapiens
gccagggatcatggtctcctcattt

SEQ ID NO: 11109 - DNA, 24 bp, Homo sapiens
gaaccacgggaccttgacttcagt

SEQ ID NO: 11110 - DNA, 23 bp, Homo sapiens
acaagcggttgacccaggccatc

SEQ ID NO: 11111 - DNA, 24 bp, Homo sapiens
gtggccccccacctgagtcaatgc

SEQ ID NO: 11112 - DNA, 24 bp, Homo sapiens
agtggccccccacctgagtcaatg

SEQ ID NO: 11113 - DNA, 24 bp, Homo sapiens
gagtggccccccacctgagtcaat

SEQ ID NO: 11114 - DNA, 23 bp, Homo sapiens
ccacagcggactcggaagacatg

SEQ ID NO: 11115 - DNA, 23 bp, Homo sapiens
tgaagcagcacaagcggttgacc

SEQ ID NO: 11116 - DNA, 24 bp, Homo sapiens
gaaccacgggaccttgacttcagt

SEQ ID NO: 11117 - DNA, 24 bp, Homo sapiens
agccgcccgcggtgcagattcact

SEQ ID NO: 11118 - DNA, 24 bp, Homo sapiens
aagccgcccgcggtgcagattcac

SEQ ID NO: 11119 - DNA, 24 bp, Homo sapiens
gaagccgcccgcggtgcagattca

SEQ ID NO: 11120 - DNA, 24 bp, Homo sapiens
gcttcccaaaggtcccagcacccc

SEQ ID NO: 11121 - DNA, 24 bp, Homo sapiens
tgcttcccaaaggtcccagcaccc

SEQ ID NO: 11122 - DNA, 24 bp, Homo sapiens
atgcttcccaaaggtcccagcacc

SEQ ID NO: 11123 - DNA, 24 bp, Homo sapiens
tgggacttcgcctgggagcagttc

SEQ ID NO: 11124 - DNA, 24 bp, Homo sapiens
atgccacactggtcaatgaggctg

SEQ ID NO: 11125 - DNA, 24 bp, Homo sapiens
ggcagccctggcctgcagcaaaga

SEQ ID NO: 11126 - DNA, 24 bp, Homo sapiens
agcaagccctggagaagacgaaag

SEQ ID NO: 11127 - DNA, 24 bp, Homo sapiens
tggagcagttcaagaaggacaacg

SEQ ID NO: 11128 - DNA, 24 bp, Homo sapiens
ccaggcagtgacacgacgattctc

SEQ ID NO: 11129 - DNA, 24 bp, Homo sapiens
ctgacaagctccgggcagccctgg

SEQ ID NO: 11130 - DNA, 24 bp, Homo sapiens
agttccgaaatgccacactggtca

SEQ ID NO: 11131 - DNA, 23 bp, Homo sapiens
gtcactgagttccacaccacgcc

SEQ ID NO: 11132 - DNA, 25 bp, Homo sapiens
acgtacttgctggccttcattgtca

SEQ ID NO: 11133 - DNA, 24 bp, Homo sapiens
atgtcactgagttccacaccacgc

SEQ ID NO: 11134 - DNA, 24 bp, Homo sapiens
gccgagttcaacatcacgcttatc

SEQ ID NO: 11135 - DNA, 24 bp, Homo sapiens
ggtgaaggacagccagtatgagat

SEQ ID NO: 11136 - DNA, 24 bp, Homo sapiens
atgtcactgagttccacaccacgc

SEQ ID NO: 11137 - DNA, 24 bp, Homo sapiens
agcaggcatccaatggtgtcttga

SEQ ID NO: 11138 - DNA, 24 bp, Homo sapiens
gccgagttcaacatcacgcttatc

SEQ ID NO: 11139 - DNA, 24 bp, Homo sapiens
aagtccttcccatgcttcgatgag

SEQ ID NO: 11140 - DNA, 24 bp, Homo sapiens
tgaaggccgagttcaacatcacgc

SEQ ID NO: 11141 - DNA, 24 bp, Homo sapiens
accccaaggacctgacagccctgt

SEQ ID NO: 11142 - DNA, 24 bp, Homo sapiens
cagaagaccccaactggaatgtca

SEQ ID NO: 11143 - DNA, 23 bp, Homo sapiens
agttccacaccacgcccaagatg

SEQ ID NO: 11144 - DNA, 23 bp, Homo sapiens
acgtacttgctggccttcattgt

SEQ ID NO: 11145 - DNA, 24 bp, Homo sapiens
gtcatcacggtggataccagcacg

SEQ ID NO: 11146 - DNA, 24 bp, Homo sapiens
agcacttcctccttgaccccgatt

SEQ ID NO: 11147 - DNA, 24 bp, Homo sapiens
atccaactccccaccaccgtgcgg

SEQ ID NO: 11148 - DNA, 24 bp, Homo sapiens
agatggcagacagcagcaggacta

SEQ ID NO: 11149 - DNA, 24 bp, Homo sapiens
tcctgctgaacctcaatgtgacgg

SEQ ID NO: 11150 - DNA, 24 bp, Homo sapiens
acgacgaagagaactggaggaaga

SEQ ID NO: 11151 - DNA, 24 bp, Homo sapiens
tcctgctgaacctcaatgtgacgg

SEQ ID NO: 11152 - DNA, 24 bp, Homo sapiens
acgacgaagagaactggaggaaga

SEQ ID NO: 11153 - DNA, 24 bp, Homo sapiens
cgctgaacaacaccctcttcctga

SEQ ID NO: 11154 - DNA, 24 bp, Homo sapiens
acgccacctctaccatcatcagca

SEQ ID NO: 11155 - DNA, 24 bp, Homo sapiens
atggtggtggctcgttctccttct

SEQ ID NO: 11156 - DNA, 24 bp, Homo sapiens
ccaggcagtgacacgacgattctc

SEQ ID NO: 11157 - DNA, 24 bp, Homo sapiens
ccaggcagtgacacgacgattctc

SEQ ID NO: 11158 - DNA, 24 bp, Homo sapiens
tggagcagttcaagaaggacaacg

SEQ ID NO: 11159 - DNA, 24 bp, Homo sapiens
tgaaggagaacaaggaggtggtgc

SEQ ID NO: 11160 - DNA, 25 bp, Homo sapiens
ggctggtcttgaacttctgacttga

SEQ ID NO: 11161 - DNA, 24 bp, Homo sapiens
ccacccacctcgtcctcctaaagt

SEQ ID NO: 11162 - DNA, 23 bp, Homo sapiens
attacaggcgtgagccactgcac

SEQ ID NO: 11163 - DNA, 25 bp, Homo sapiens
gcttccttcgtccagtggatgttca

SEQ ID NO: 11164 - DNA, 25 bp, Homo sapiens
tgaagaggagacaacaacaagacat

SEQ ID NO: 11165 - DNA, 25 bp, Homo sapiens
aaccttctaatgcctatggactacc

SEQ ID NO: 11166 - DNA, 24 bp, Homo sapiens
cgacagcagattatctccaggtgg

SEQ ID NO: 11167 - DNA, 25 bp, Homo sapiens
gcacatcaagaaggcactcatccga

SEQ ID NO: 11168 - DNA, 25 bp, Homo sapiens
tgacgcactttacagatgaatgtgt

SEQ ID NO: 11169 - DNA, 23 bp, Homo sapiens
caatcagcgagactcggtgggcg

SEQ ID NO: 11170 - DNA, 25 bp, Homo sapiens
cttcccagctgctttgtttacctaa

SEQ ID NO: 11171 - DNA, 24 bp, Homo sapiens
ttgcagtttgatctcagactgctg

SEQ ID NO: 11172 - DNA, 24 bp, Homo sapiens
attggtaatcggtgagtaaagcag

SEQ ID NO: 11173 - DNA, 24 bp, Homo sapiens
aattggtaatcggtgagtaaagca

SEQ ID NO: 11174 - DNA, 24 bp, Homo sapiens
aaattggtaatcggtgagtaaagc

SEQ ID NO: 11175 - DNA, 24 bp, Homo sapiens
gcacatctttcttggacttgggat

SEQ ID NO: 11176 - DNA, 24 bp, Homo sapiens
ttccagtttattagcagcaactgc

SEQ ID NO: 11177 - DNA, 24 bp, Homo sapiens
tggtgttttgggttaattgcttct

SEQ ID NO: 11178 - DNA, 24 bp, Homo sapiens
cgcctgtggtaaatgatggtgtgg

SEQ ID NO: 11179 - DNA, 24 bp, Homo sapiens
gatgtggatgccttaatgaagagc

SEQ ID NO: 11180 - DNA, 24 bp, Homo sapiens
gccagcggtatgtggaagtatatg

SEQ ID NO: 11181 - DNA, 24 bp, Homo sapiens
ctaccctgccctccgtgcctctct

SEQ ID NO: 11182 - DNA, 24 bp, Homo sapiens
ccgcctgcctgcccttctactccg

SEQ ID NO: 11183 - DNA, 24 bp, Homo sapiens
ctgctccggggctgcggctgtaac

SEQ ID NO: 11184 - DNA, 24 bp, Homo sapiens
tgagacccatgaggatgctgttgc

SEQ ID NO: 11185 - DNA, 24 bp, Homo sapiens
gggctccagataataagggtgaag

SEQ ID NO: 11186 - DNA, 24 bp, Homo sapiens
gcacatctttcttggacttgggat

SEQ ID NO: 11187 - DNA, 24 bp, Homo sapiens
gatgtggatgccttaatgaagagc

SEQ ID NO: 11188 - DNA, 24 bp, Homo sapiens
cgcctgtggtaaatgatggtgtgg

SEQ ID NO: 11189 - DNA, 24 bp, Homo sapiens
tccaagcagaaggaatgaagttcg

SEQ ID NO: 11190 - DNA, 24 bp, Homo sapiens
cgcctgtggtaaatgatggtgtgg

SEQ ID NO: 11191 - DNA, 24 bp, Homo sapiens
gatgtggatgccttaatgaagagc

SEQ ID NO: 11192 - DNA, 24 bp, Homo sapiens
tgagaggacttccttatagttgca

SEQ ID NO: 11193 - DNA, 24 bp, Homo sapiens
ctacatctgttctcgctactaccg

SEQ ID NO: 11194 - DNA, 24 bp, Homo sapiens
gagccactgattacacctcatcca

SEQ ID NO: 11195 - DNA, 24 bp, Homo sapiens
gctggtggagatcatcaaggtgct

SEQ ID NO: 11196 - DNA, 24 bp, Homo sapiens
ttccgcagcttggcctacatccac

SEQ ID NO: 11197 - DNA, 24 bp, Homo sapiens
ggaccctgacactgctgtcctcaa

SEQ ID NO: 11198 - DNA, 24 bp, Homo sapiens
caccgcgacatcaagccccagaac

SEQ ID NO: 11199 - DNA, 24 bp, Homo sapiens
tgctctagcctgctggagtacacc

SEQ ID NO: 11200 - DNA, 24 bp, Homo sapiens
gatgaactgcgatgtctgggaacc

SEQ ID NO: 11201 - DNA, 24 bp, Homo sapiens
tgaactctccatccaaccgtctct

SEQ ID NO: 11202 - DNA, 24 bp, Homo sapiens
aggtggaagaagagcccctcaata

SEQ ID NO: 11203 - DNA, 24 bp, Homo sapiens
caggtggaagaagagcccctcaat

SEQ ID NO: 11204 - DNA, 24 bp, Homo sapiens
gcaggtggaagaagagcccctcaa

SEQ ID NO: 11205 - DNA, 24 bp, Homo sapiens
gcaagttcaacagcagcatcaacc

SEQ ID NO: 11206 - DNA, 24 bp, Homo sapiens
cagcagcatcaccaccatcaccat

SEQ ID NO: 11207 - DNA, 25 bp, Homo sapiens
agcaagccacagcaccacaagttat

SEQ ID NO: 11208 - DNA, 24 bp, Homo sapiens
cagcagcatcaccaccatcaccat

SEQ ID NO: 11209 - DNA, 24 bp, Homo sapiens
gcaagttcaacagcagcatcaacc

SEQ ID NO: 11210 - DNA, 25 bp, Homo sapiens
ggatttcattcagaagagcagcagc

SEQ ID NO: 11211 - DNA, 25 bp, Homo sapiens
ctcagcagacagtacctcagcaagc

SEQ ID NO: 11212 - DNA, 24 bp, Homo sapiens
cagcagcatcaccaccatcaccat

SEQ ID NO: 11213 - DNA, 24 bp, Homo sapiens
gcaagttcaacagcagcatcaacc

SEQ ID NO: 11214 - DNA, 23 bp, Homo sapiens
agcaagccacagcaccacaagtt

SEQ ID NO: 11215 - DNA, 25 bp, Homo sapiens
ctcagcagacagtacctcagcaagc

SEQ ID NO: 11216 - DNA, 24 bp, Homo sapiens
cagcagcatcaccaccatcaccat

SEQ ID NO: 11217 - DNA, 25 bp, Homo sapiens
agcctcagcagtcagtggttctaca

SEQ ID NO: 11218 - DNA, 23 bp, Homo sapiens
aggtgctggctcctcttcctgga

SEQ ID NO: 11219 - DNA, 24 bp, Homo sapiens
ggtgtcatcatccagcctcagcaa

SEQ ID NO: 11220 - DNA, 25 bp, Homo sapiens
agcctcagcagtcagtggttctaca

SEQ ID NO: 11221 - DNA, 24 bp, Homo sapiens
cttcttcaggtggtcagagcagcc

SEQ ID NO: 11222 - DNA, 23 bp, Homo sapiens
agcaagccacagcaccacaagtt

SEQ ID NO: 11223 - DNA, 24 bp, Homo sapiens
cttggttgtaggtgaccgggttat

SEQ ID NO: 11224 - DNA, 24 bp, Homo sapiens
gcttggttgtaggtgaccgggtta

SEQ ID NO: 11225 - DNA, 24 bp, Homo sapiens
ggcttggttgtaggtgaccgggtt

SEQ ID NO: 11226 - DNA, 24 bp, Homo sapiens
gcttccacctgcaccttctagcca

SEQ ID NO: 11227 - DNA, 24 bp, Homo sapiens
agcttccacctgcaccttctagcc

SEQ ID NO: 11228 - DNA, 24 bp, Homo sapiens
tagcttccacctgcaccttctagc

SEQ ID NO: 11229 - DNA, 24 bp, Homo sapiens
ctgcatttctggctgatgtccggc

SEQ ID NO: 11230 - DNA, 24 bp, Homo sapiens
gctgcatttctggctgatgtccgg

SEQ ID NO: 11231 - DNA, 24 bp, Homo sapiens
tgctgcatttctggctgatgtccg

SEQ ID NO: 11232 - DNA, 24 bp, Homo sapiens
actgatggctgtaacggtctaaga

SEQ ID NO: 11233 - DNA, 24 bp, Homo sapiens
tcggctgaatacagggtcaaagga

SEQ ID NO: 11234 - DNA, 24 bp, Homo sapiens
ttagatgagggctatggcatttcc

SEQ ID NO: 11235 - DNA, 24 bp, Homo sapiens
catcacagcactgtcacctggagg

SEQ ID NO: 11236 - DNA, 24 bp, Homo sapiens
cagggaggaacacagcaagccata

SEQ ID NO: 11237 - DNA, 24 bp, Homo sapiens
gcagtcacggcgtctgatgaagaa

SEQ ID NO: 11238 - DNA, 24 bp, Homo sapiens
gtgtttgtcaatattctgcaattt

SEQ ID NO: 11239 - DNA, 24 bp, Homo sapiens
tgtgtttgtcaatattctgcaatt

SEQ ID NO: 11240 - DNA, 24 bp, Homo sapiens
gtgtgtttgtcaatattctgcaat

SEQ ID NO: 11241 - DNA, 24 bp, Homo sapiens
gttgttaaaaagtaagttcttttt

SEQ ID NO: 11242 - DNA, 24 bp, Homo sapiens
cgttgttaaaaagtaagttctttt

SEQ ID NO: 11243 - DNA, 24 bp, Homo sapiens
tcgttgttaaaaagtaagttcttt

SEQ ID NO: 11244 - DNA, 24 bp, Homo sapiens
ccaggtggaaggtaaaacctaatt

SEQ ID NO: 11245 - DNA, 24 bp, Homo sapiens
tccaggtggaaggtaaaacctaat

SEQ ID NO: 11246 - DNA, 24 bp, Homo sapiens
ctccaggtggaaggtaaaacctaa

SEQ ID NO: 11247 - DNA, 24 bp, Homo sapiens
aagccgtttgtttgtgcagccaat

SEQ ID NO: 11248 - DNA, 24 bp, Homo sapiens
aaagccgtttgtttgtgcagccaa

SEQ ID NO: 11249 - DNA, 24 bp, Homo sapiens
aaaagccgtttgtttgtgcagcca

SEQ ID NO: 11250 - DNA, 24 bp, Homo sapiens
ggcaaaagatggctccaccgagga

SEQ ID NO: 11251 - DNA, 24 bp, Homo sapiens
tggcaaaagatggctccaccgagg

SEQ ID NO: 11252 - DNA, 24 bp, Homo sapiens
tggcaaaagatggctccaccgagg

SEQ ID NO: 11253 - DNA, 24 bp, Homo sapiens
ctccattttaggctcacggaattt

SEQ ID NO: 11254 - DNA, 24 bp, Homo sapiens
gctccattttaggctcacggaatt

SEQ ID NO: 11255 - DNA, 24 bp, Homo sapiens
gctccattttaggctcacggaatt

SEQ ID NO: 11256 - DNA, 25 bp, Homo sapiens
ccaccagtcagttgaccattgatga

SEQ ID NO: 11257 - DNA, 24 bp, Homo sapiens
aagatcgacctggaggaggagtgc

SEQ ID NO: 11258 - DNA, 23 bp, Homo sapiens
ccctcgtacacagctgggcagag

SEQ ID NO: 11259 - DNA, 24 bp, Homo sapiens
ccgatgactttgacagcgactatg

SEQ ID NO: 11260 - DNA, 24 bp, Homo sapiens
tccgatgactttgacagcgactat

SEQ ID NO: 11261 - DNA, 24 bp, Homo sapiens
gtccgatgactttgacagcgacta

SEQ ID NO: 11262 - DNA, 24 bp, Homo sapiens
acctgaaaaagctcccatggtgaa

SEQ ID NO: 11263 - DNA, 24 bp, Homo sapiens
cacctgaaaaagctcccatggtga

SEQ ID NO: 11264 - DNA, 24 bp, Homo sapiens
ccacctgaaaaagctcccatggtg

SEQ ID NO: 11265 - DNA, 25 bp, Homo sapiens
tgaggatgaggctgattatgtggtc

SEQ ID NO: 11266 - DNA, 23 bp, Homo sapiens
agccgcctccagtagagcaggaa

SEQ ID NO: 11267 - DNA, 23 bp, Homo sapiens
cgccgaggagaacgctgatgaca

SEQ ID NO: 11268 - DNA, 24 bp, Homo sapiens
gcacctccaagtgttcctcgaagg

SEQ ID NO: 11269 - DNA, 23 bp, Homo sapiens
agagagccctgctgacgaagagg

SEQ ID NO: 11270 - DNA, 25 bp, Homo sapiens
tcaaagcacctccaagtgttcctcg

SEQ ID NO: 11271 - DNA, 23 bp, Homo sapiens
ccagtcagaagttgaggcagctt

SEQ ID NO: 11272 - DNA, 25 bp, Homo sapiens
tgaggatgaggctgattatgtggtc

SEQ ID NO: 11273 - DNA, 23 bp, Homo sapiens
acctcaagtcccacccaaaccca

SEQ ID NO: 11274 - DNA, 25 bp, Homo sapiens
cacccttcagcaagacacttcccag

SEQ ID NO: 11275 - DNA, 24 bp, Homo sapiens
gccattagcagagttcttgaagcc

SEQ ID NO: 11276 - DNA, 24 bp, Homo sapiens
agccattagcagagttcttgaagc

SEQ ID NO: 11277 - DNA, 24 bp, Homo sapiens
aagccattagcagagttcttgaag

SEQ ID NO: 11278 - DNA, 25 bp, Homo sapiens
gttcctcatctgtgcttatcagaat

SEQ ID NO: 11279 - DNA, 25 bp, Homo sapiens
actcttgtctaaaggcttatacaga

SEQ ID NO: 11280 - DNA, 24 bp, Homo sapiens
gatgaagaattgatatcacattat

SEQ ID NO: 11281 - DNA, 24 bp, Homo sapiens
cagcctcccagagtgccatgctgc

SEQ ID NO: 11282 - DNA, 24 bp, Homo sapiens
tcagcctcccagagtgccatgctg

SEQ ID NO: 11283 - DNA, 24 bp, Homo sapiens
ctcagcctcccagagtgccatgct

SEQ ID NO: 11284 - DNA, 24 bp, Homo sapiens
tcatcgtgggcgtcatgttcttcg

SEQ ID NO: 11285 - DNA, 23 bp, Homo sapiens
tgttccgcaggacctccaccttc

SEQ ID NO: 11286 - DNA, 24 bp, Homo sapiens
gatcaaggcgcggacgctatctac

SEQ ID NO: 11287 - DNA, 23 bp, Homo sapiens
gctcaagccattcgtctgcctca

SEQ ID NO: 11288 - DNA, 25 bp, Homo sapiens
ccttatttcccaggctggtctcgaa

SEQ ID NO: 11289 - DNA, 24 bp, Homo sapiens
ccagcggcaactgtagatcatagc

SEQ ID NO: 11290 - DNA, 25 bp, Homo sapiens
gcaacttggatgaagagatgaagaa

SEQ ID NO: 11291 - DNA, 25 bp, Homo sapiens
aattacgttgctatggacaccgagt

SEQ ID NO: 11292 - DNA, 23 bp, Homo sapiens
gctatgagtgccaggtctgctcc

SEQ ID NO: 11293 - DNA, 25 bp, Homo sapiens
gctagggtgctctttctcaaacaaa

SEQ ID NO: 11294 - DNA, 25 bp, Homo sapiens
gcctagctggtagtaccacatgagc

SEQ ID NO: 11295 - DNA, 24 bp, Homo sapiens
gtcttctgcaggcatcctgtcggc

SEQ ID NO: 11296 - DNA, 24 bp, Homo sapiens
tgtcttctgcaggcatcctgtcgg

SEQ ID NO: 11297 - DNA, 24 bp, Homo sapiens
ctgtcttctgcaggcatcctgtcg

SEQ ID NO: 11298 - DNA, 25 bp, Homo sapiens
ctgtggagaagaagctgatggcatt

SEQ ID NO: 11299 - DNA, 23 bp, Homo sapiens
catcgtggtctcctgtgcggctg

SEQ ID NO: 11300 - DNA, 24 bp, Homo sapiens
cagcaacaaggagacggtgaagca

SEQ ID NO: 11301 - DNA, 25 bp, Homo sapiens
aatgggtgctggaatttgcctgcta

SEQ ID NO: 11302 - DNA, 25 bp, Homo sapiens
ttgttgctggcttaattgtcctact

SEQ ID NO: 11303 - DNA, 25 bp, Homo sapiens
gccgaggaatggaatttgaaggtgc

SEQ ID NO: 11304 - DNA, 24 bp, Homo sapiens
gtcagcagcaggtcaccacctatt

SEQ ID NO: 11305 - DNA, 24 bp, Homo sapiens
cgtcagcagcaggtcaccacctat

SEQ ID NO: 11306 - DNA, 24 bp, Homo sapiens
ccgtcagcagcaggtcaccaccta

SEQ ID NO: 11307 - DNA, 24 bp, Homo sapiens
tctcctgacttcgtgatccgcctg

SEQ ID NO: 11308 - DNA, 24 bp, Homo sapiens
gttcacgcctcagcctccctagta

SEQ ID NO: 11309 - DNA, 25 bp, Homo sapiens
caaagtgctgggattacaggtgtga

SEQ ID NO: 11310 - DNA, 24 bp, Homo sapiens
gcccaccccaggccgttcctcccc

SEQ ID NO: 11311 - DNA, 24 bp, Homo sapiens
cgcccaccccaggccgttcctccc

SEQ ID NO: 11312 - DNA, 24 bp, Homo sapiens
ccgcccaccccaggccgttcctcc

SEQ ID NO: 11313 - DNA, 24 bp, Homo sapiens
atgtgcagaaggtgctggcgggca

SEQ ID NO: 11314 - DNA, 24 bp, Homo sapiens
gatgtgcagaaggtgctggcgggc

SEQ ID NO: 11315 - DNA, 24 bp, Homo sapiens
ggatgtgcagaaggtgctggcggg

SEQ ID NO: 11316 - DNA, 24 bp, Homo sapiens
aaactccgcaagctcagaatcatt

SEQ ID NO: 11317 - DNA, 24 bp, Homo sapiens
taaactccgcaagctcagaatcat

SEQ ID NO: 11318 - DNA, 24 bp, Homo sapiens
gtaaactccgcaagctcagaatca

SEQ ID NO: 11319 - DNA, 24 bp, Homo sapiens
tggaccgcaggaatgcagtggtgt

SEQ ID NO: 11320 - DNA, 24 bp, Homo sapiens
atggaccgcaggaatgcagtggtg

SEQ ID NO: 11321 - DNA, 24 bp, Homo sapiens
gatggaccgcaggaatgcagtggt

SEQ ID NO: 11322 - DNA, 25 bp, Homo sapiens
agaatggtggcgaacaactgatgct

SEQ ID NO: 11323 - DNA, 24 bp, Homo sapiens
accatcctcagcagcctcctctac

SEQ ID NO: 11324 - DNA, 25 bp, Homo sapiens
cgacaccttctgtggcttcagtagt

SEQ ID NO: 11325 - DNA, 25 bp, Homo sapiens
aagcagatggacagaaagcaactga

SEQ ID NO: 11326 - DNA, 24 bp, Homo sapiens
acaccagccattacctcttgcgtt

SEQ ID NO: 11327 - DNA, 23 bp, Homo sapiens
ccaatcccagcagaagcagcctc

SEQ ID NO: 11328 - DNA, 24 bp, Homo sapiens
acaccagccattacctcttgcgtt

SEQ ID NO: 11329 - DNA, 23 bp, Homo sapiens
ccaatcccagcagaagcagcctc

SEQ ID NO: 11330 - DNA, 25 bp, Homo sapiens
aggcaaaggaggaatctgtgaacaa

SEQ ID NO: 11331 - DNA, 23 bp, Homo sapiens
gcagcaagagtgtggtcagtgaa

SEQ ID NO: 11332 - DNA, 25 bp, Homo sapiens
tgggtggtagaaggtaaactccgca

SEQ ID NO: 11333 - DNA, 25 bp, Homo sapiens
gacacttcaggtggcattgatctgg

SEQ ID NO: 11334 - DNA, 23 bp, Homo sapiens
ctcacagtcgcccaacacagcca

SEQ ID NO: 11335 - DNA, 24 bp, Homo sapiens
tcaagtcagaagatgagccaacgc

SEQ ID NO: 11336 - DNA, 25 bp, Homo sapiens
aggagtgtctcaacaacattggcga

SEQ ID NO: 11337 - DNA, 25 bp, Homo sapiens
ttcctgacttcaacaactacctgat

SEQ ID NO: 11338 - DNA, 23 bp, Homo sapiens
ctcacagtcgcccaacacagcca

SEQ ID NO: 11339 - DNA, 25 bp, Homo sapiens
tcgtgcaggataaactcaaacaact

SEQ ID NO: 11340 - DNA, 24 bp, Homo sapiens
gatttacagaagccctccgttcct

SEQ ID NO: 11341 - DNA, 23 bp, Homo sapiens
ccaaaaaagcctcggccacctaa

SEQ ID NO: 11342 - DNA, 24 bp, Homo sapiens
ctgccatgaagggccttggaactg

SEQ ID NO: 11343 - DNA, 24 bp, Homo sapiens
gctgccatgaagggccttggaact

SEQ ID NO: 11344 - DNA, 24 bp, Homo sapiens
tgctgccatgaagggccttggaac

SEQ ID NO: 11345 - DNA, 24 bp, Homo sapiens
ctgccatgaaggtaaatcgcccaa

SEQ ID NO: 11346 - DNA, 24 bp, Homo sapiens
gctgccatgaaggtaaatcgccca

SEQ ID NO: 11347 - DNA, 24 bp, Homo sapiens
tgctgccatgaaggtaaatcgccc

SEQ ID NO: 11348 - DNA, 24 bp, Homo sapiens
tgagggagatcgcgcaggatttca

SEQ ID NO: 11349 - DNA, 24 bp, Homo sapiens
gtgagggagatcgcgcaggatttc

SEQ ID NO: 11350 - DNA, 24 bp, Homo sapiens
ggtgagggagatcgcgcaggattt

SEQ ID NO: 11351 - DNA, 24 bp, Homo sapiens
cttcaagtctggaatgttccggag

SEQ ID NO: 11352 - DNA, 24 bp, Homo sapiens
tcttcaagtctggaatgttccgga

SEQ ID NO: 11353 - DNA, 24 bp, Homo sapiens
atcttcaagtctggaatgttccgg

SEQ ID NO: 11354 - DNA, 24 bp, Homo sapiens
tactgctgcttgtcaaccacaccg

SEQ ID NO: 11355 - DNA, 24 bp, Homo sapiens
aacttgcgggctcgttccatgatc

SEQ ID NO: 11356 - DNA, 24 bp, Homo sapiens
taggctgttccgcagtgatggctg

SEQ ID NO: 11357 - DNA, 24 bp, Homo sapiens
aggttcgaggagccactgccattc

SEQ ID NO: 11358 - DNA, 24 bp, Homo sapiens
gaccctcatctgctccatcctcag

SEQ ID NO: 11359 - DNA, 24 bp, Homo sapiens
tcttgaactacatcgatcatggag

SEQ ID NO: 11360 - DNA, 24 bp, Homo sapiens
tactgctgcttgtcaaccacaccg

SEQ ID NO: 11361 - DNA, 24 bp, Homo sapiens
atggctgtggcggcagtttctaca

SEQ ID NO: 11362 - DNA, 24 bp, Homo sapiens
aacttgcgggctcgttccatgatc

SEQ ID NO: 11363 - DNA, 24 bp, Homo sapiens
ggccggcccgggtgagcagcgcgg

SEQ ID NO: 11364 - DNA, 24 bp, Homo sapiens
tggccggcccgggtgagcagcgcg

SEQ ID NO: 11365 - DNA, 24 bp, Homo sapiens
ctggccggcccgggtgagcagcgc

SEQ ID NO: 11366 - DNA, 24 bp, Homo sapiens
gatcatgagagcctgtagccacca

SEQ ID NO: 11367 - DNA, 24 bp, Homo sapiens
agatcatgagagcctgtagccacc

SEQ ID NO: 11368 - DNA, 24 bp, Homo sapiens
gagatcatgagagcctgtagccac

SEQ ID NO: 11369 - DNA, 24 bp, Homo sapiens
cgatccaaccggcagaaggagtac

SEQ ID NO: 11370 - DNA, 24 bp, Homo sapiens
caaacttgggctcgcgcttcccgg

SEQ ID NO: 11371 - DNA, 24 bp, Homo sapiens
gagccttgccccgatccgcgcccg

SEQ ID NO: 11372 - DNA, 24 bp, Homo sapiens
agtgattcttctgcctcagcctcc

SEQ ID NO: 11373 - DNA, 24 bp, Homo sapiens
agtgatccacctacctcagcctcc

SEQ ID NO: 11374 - DNA, 24 bp, Homo sapiens
gatctcggctcactgcaacatacc

SEQ ID NO: 11375 - DNA, 24 bp, Homo sapiens
tccactttgaggactttgtggttg

SEQ ID NO: 11376 - DNA, 24 bp, Homo sapiens
atccactttgaggactttgtggtt

SEQ ID NO: 11377 - DNA, 24 bp, Homo sapiens
catccactttgaggactttgtggt

SEQ ID NO: 11378 - DNA, 23 bp, Homo sapiens
gcacacttcctcttcaacgcctt

SEQ ID NO: 11379 - DNA, 23 bp, Homo sapiens
actttgaggactttgtggttggc

SEQ ID NO: 11380 - DNA, 24 bp, Homo sapiens
ggcacagtccacgagaagctcaag

SEQ ID NO: 11381 - DNA, 23 bp, Homo sapiens
actttgaggactttgtggttggc

SEQ ID NO: 11382 - DNA, 23 bp, Homo sapiens
gcacacttcctcttcaacgcctt

SEQ ID NO: 11383 - DNA, 25 bp, Homo sapiens
cagaccaagttcaccaagaaggagc

SEQ ID NO: 11384 - DNA, 25 bp, Homo sapiens
tctctacgacattaacaaggatggc

SEQ ID NO: 11385 - DNA, 23 bp, Homo sapiens
actttgaggactttgtggttggc

SEQ ID NO: 11386 - DNA, 23 bp, Homo sapiens
gcacacttcctcttcaacgcctt

SEQ ID NO: 11387 - DNA, 24 bp, Homo sapiens
gattcttgtgcctcagctttccga

SEQ ID NO: 11388 - DNA, 23 bp, Homo sapiens
ggctcactgcaacctctgcctcc

SEQ ID NO: 11389 - DNA, 23 bp, Homo sapiens
cccaggctggagagcagtggcat

SEQ ID NO: 11390 - DNA, 24 bp, Homo sapiens
gacaagaaaaagtaagcccattcc

SEQ ID NO: 11391 - DNA, 24 bp, Homo sapiens
cgacaagaaaaagtaagcccattc

SEQ ID NO: 11392 - DNA, 24 bp, Homo sapiens
acgacaagaaaaagtaagcccatt

SEQ ID NO: 11393 - DNA, 24 bp, Homo sapiens
gctttcattaggccttgtgaaaaa

SEQ ID NO: 11394 - DNA, 24 bp, Homo sapiens
tgctttcattaggccttgtgaaaa

SEQ ID NO: 11395 - DNA, 24 bp, Homo sapiens
atgctttcattaggccttgtgaaa

SEQ ID NO: 11396 - DNA, 24 bp, Homo sapiens
tggcagcaacggtgagtagttatt

SEQ ID NO: 11397 - DNA, 24 bp, Homo sapiens
ttggcagcaacggtgagtagttat

SEQ ID NO: 11398 - DNA, 24 bp, Homo sapiens
tttggcagcaacggtgagtagtta

SEQ ID NO: 11399 - DNA, 24 bp, Homo sapiens
tggctacaatactgcacaaacttg

SEQ ID NO: 11400 - DNA, 24 bp, Homo sapiens
ctggctacaatactgcacaaactt

SEQ ID NO: 11401 - DNA, 24 bp, Homo sapiens
cctggctacaatactgcacaaact

SEQ ID NO: 11402 - DNA, 24 bp, Homo sapiens
accctagtcagcctgccacagtga

SEQ ID NO: 11403 - DNA, 24 bp, Homo sapiens
taccctagtcagcctgccacagtg

SEQ ID NO: 11404 - DNA, 24 bp, Homo sapiens
ttaccctagtcagcctgccacagt

SEQ ID NO: 11405 - DNA, 24 bp, Homo sapiens
cggccgcggagagccccgcttcat

SEQ ID NO: 11406 - DNA, 24 bp, Homo sapiens
ccggccgcggagagccccgcttca

SEQ ID NO: 11407 - DNA, 24 bp, Homo sapiens
cccggccgcggagagccccgcttc

SEQ ID NO: 11408 - DNA, 24 bp, Homo sapiens
cggccgcggagtattgggaccggg

SEQ ID NO: 11409 - DNA, 24 bp, Homo sapiens
ccggccgcggagtattgggaccgg

SEQ ID NO: 11410 - DNA, 24 bp, Homo sapiens
cccggccgcggagtattgggaccg

SEQ ID NO: 11411 - DNA, 24 bp, Homo sapiens
gtgtttcccaaggagcctgtggag

SEQ ID NO: 11412 - DNA, 24 bp, Homo sapiens
tctgccacattgacaagttcttcc

SEQ ID NO: 11413 - DNA, 24 bp, Homo sapiens
agcctcttcctgcccagaacagat

SEQ ID NO: 11414 - DNA, 24 bp, Homo sapiens
tccacaagttccattacctgacct

SEQ ID NO: 11415 - DNA, 24 bp, Homo sapiens
ccagcacttagggaggccgaggag

SEQ ID NO: 11416 - DNA, 24 bp, Homo sapiens
tgggcagagtgcggcagctcatgc

SEQ ID NO: 11417 - DNA, 24 bp, Homo sapiens
ggtgacagggtgaaacgccatctc

SEQ ID NO: 11418 - DNA, 24 bp, Homo sapiens
agtgagccaggattgtgcgactgc

SEQ ID NO: 11419 - DNA, 24 bp, Homo sapiens
ggaggcaggagaatggcgtcaacc

SEQ ID NO: 11420 - DNA, 24 bp, Homo sapiens
ggtgacagggtgaaacgccatctc

SEQ ID NO: 11421 - DNA, 24 bp, Homo sapiens
agtgagccaggattgtgcgactgc

SEQ ID NO: 11422 - DNA, 24 bp, Homo sapiens
gaagagctcagatagaaacagagg

SEQ ID NO: 11423 - DNA, 24 bp, Homo sapiens
agaagagctcagatagaaacagag

SEQ ID NO: 11424 - DNA, 24 bp, Homo sapiens
aagaagagctcagatagaaacaga

SEQ ID NO: 11425 - DNA, 25 bp, Homo sapiens
agtgttgttcgtggtctgctgatgg

SEQ ID NO: 11426 - DNA, 25 bp, Homo sapiens
gtcatcatcttctcttagccactgg

SEQ ID NO: 11427 - DNA, 25 bp, Homo sapiens
acacctatgatgagcactcagagca

SEQ ID NO: 11428 - DNA, 25 bp, Homo sapiens
ttgatggaacagtgaaggtatggaa

SEQ ID NO: 11429 - DNA, 25 bp, Homo sapiens
catctacctctgctgacaagactgc

SEQ ID NO: 11430 - DNA, 25 bp, Homo sapiens
ctggcaacgggagatgacaatggag

SEQ ID NO: 11431 - DNA, 24 bp, Homo sapiens
ctgcagaacagtgtgaagcagtat

SEQ ID NO: 11432 - DNA, 24 bp, Homo sapiens
gctgcagaacagtgtgaagcagta

SEQ ID NO: 11433 - DNA, 24 bp, Homo sapiens
tgctgcagaacagtgtgaagcagt

SEQ ID NO: 11434 - DNA, 24 bp, Homo sapiens
gaccaatgcagtacaatgccagtg

SEQ ID NO: 11435 - DNA, 24 bp, Homo sapiens
tgaccaatgcagtacaatgccagt

SEQ ID NO: 11436 - DNA, 24 bp, Homo sapiens
atgaccaatgcagtacaatgccag

SEQ ID NO: 11437 - DNA, 24 bp, Homo sapiens
ggccccgagcggtatgtcccaaca

SEQ ID NO: 11438 - DNA, 24 bp, Homo sapiens
tggccccgagcggtatgtcccaac

SEQ ID NO: 11439 - DNA, 24 bp, Homo sapiens
gtggccccgagcggtatgtcccaa

SEQ ID NO: 11440 - DNA, 24 bp, Homo sapiens
gtttgatgaccgtcgcggacgccc

SEQ ID NO: 11441 - DNA, 24 bp, Homo sapiens
tgtttgatgaccgtcgcggacgcc

SEQ ID NO: 11442 - DNA, 24 bp, Homo sapiens
atgtttgatgaccgtcgcggacgc

SEQ ID NO: 11443 - DNA, 23 bp, Homo sapiens
gtccgacccagaacgcttcagtt

SEQ ID NO: 11444 - DNA, 25 bp, Homo sapiens
agaagatatggaagaggaacaagca

SEQ ID NO: 11445 - DNA, 25 bp, Homo sapiens
actgatgagatggttgaattacgca

SEQ ID NO: 11446 - DNA, 25 bp, Homo sapiens
ggaaactgaacagccagaagaaacc

SEQ ID NO: 11447 - DNA, 25 bp, Homo sapiens
agaagatatggaagaggaacaagca

SEQ ID NO: 11448 - DNA, 25 bp, Homo sapiens
actgatgagatggttgaattacgca

SEQ ID NO: 11449 - DNA, 25 bp, Homo sapiens
accattacaggaacacaggaccaga

SEQ ID NO: 11450 - DNA, 25 bp, Homo sapiens
gaacagtgtgaagcagtattctgga

SEQ ID NO: 11451 - DNA, 24 bp, Homo sapiens
agtgaagaactgaaggagtcctgc

SEQ ID NO: 11452 - DNA, 24 bp, Homo sapiens
acttctttgagatctgcgatgagc

SEQ ID NO: 11453 - DNA, 24 bp, Homo sapiens
aacttctttgagatctgcgatgag

SEQ ID NO: 11454 - DNA, 24 bp, Homo sapiens
gaacttctttgagatctgcgatga

SEQ ID NO: 11455 - DNA, 24 bp, Homo sapiens
gatggtggaatttgactcagttca

SEQ ID NO: 11456 - DNA, 24 bp, Homo sapiens
cgatggtggaatttgactcagttc

SEQ ID NO: 11457 - DNA, 24 bp, Homo sapiens
gcgatggtggaatttgactcagtt

SEQ ID NO: 11458 - DNA, 23 bp, Homo sapiens
aagagacaagcactggtggagtt

SEQ ID NO: 11459 - DNA, 23 bp, Homo sapiens
gtgaactacgcagccgacaacca

SEQ ID NO: 11460 - DNA, 25 bp, Homo sapiens
tgtcaactactctaccagccagaag

SEQ ID NO: 11461 - DNA, 25 bp, Homo sapiens
gagtgaagcggccatcttctgtgaa

SEQ ID NO: 11462 - DNA, 24 bp, Homo sapiens
ccaataacaacaactatgccaacg

SEQ ID NO: 11463 - DNA, 24 bp, Homo sapiens
ataagatcgcctccaccgttgtcg

SEQ ID NO: 11464 - DNA, 24 bp, Homo sapiens
ttctgaaggtggcggagggaaggg

SEQ ID NO: 11465 - DNA, 24 bp, Homo sapiens
acctgaagcacgactctgtcctca

SEQ ID NO: 11466 - DNA, 24 bp, Homo sapiens
gccgtggactgtgtgatatacctg

SEQ ID NO: 11467 - DNA, 24 bp, Homo sapiens
gtcgttcacctgctgtctaccatg

SEQ ID NO: 11468 - DNA, 24 bp, Homo sapiens
cactctgcccgacgtggtctccca

SEQ ID NO: 11469 - DNA, 24 bp, Homo sapiens
ccactctgcccgacgtggtctccc

SEQ ID NO: 11470 - DNA, 24 bp, Homo sapiens
tccactctgcccgacgtggtctcc

SEQ ID NO: 11471 - DNA, 24 bp, Homo sapiens
agccccagggcgtcccgccggccg

SEQ ID NO: 11472 - DNA, 24 bp, Homo sapiens
cagccccagggcgtcccgccggcc

SEQ ID NO: 11473 - DNA, 24 bp, Homo sapiens
ccagccccagggcgtcccgccggc

SEQ ID NO: 11474 - DNA, 24 bp, Homo sapiens
tttcttactaggaatcaaccctca

SEQ ID NO: 11475 - DNA, 24 bp, Homo sapiens
gtttcttactaggaatcaaccctc

SEQ ID NO: 11476 - DNA, 24 bp, Homo sapiens
tgtttcttactaggaatcaaccct

SEQ ID NO: 11477 - DNA, 24 bp, Homo sapiens
gtatcaagccgttctggagagtgc

SEQ ID NO: 11478 - DNA, 24 bp, Homo sapiens
gtccctccgttcttatggaagccg

SEQ ID NO: 11479 - DNA, 24 bp, Homo sapiens
tggaagcagagaaagtactggata

SEQ ID NO: 11480 - DNA, 24 bp, Homo sapiens
tcctccctgaccacccatgccctt

SEQ ID NO: 11481 - DNA, 24 bp, Homo sapiens
ctcctccctgaccacccatgccct

SEQ ID NO: 11482 - DNA, 24 bp, Homo sapiens
cctcctccctgaccacccatgccc

SEQ ID NO: 11483 - DNA, 24 bp, Homo sapiens
ctactgagtcaggttaggtggtgg

SEQ ID NO: 11484 - DNA, 25 bp, Homo sapiens
ggtagcaagttcatgtgtcctcctt

SEQ ID NO: 11485 - DNA, 25 bp, Homo sapiens
gggaagtggacaggaaacatgaggt

SEQ ID NO: 11486 - DNA, 23 bp, Homo sapiens
ggattacacgcagaaggcaccat

SEQ ID NO: 11487 - DNA, 23 bp, Homo sapiens
ggttaagagccagataaggagaa

SEQ ID NO: 11488 - DNA, 24 bp, Homo sapiens
ccacaggcgatttcttcaagcagc

SEQ ID NO: 11489 - DNA, 25 bp, Homo sapiens
agactggcatgaatgtggagttagc

SEQ ID NO: 11490 - DNA, 25 bp, Homo sapiens
ccagcttccagatccgagactatgt

SEQ ID NO: 11491 - DNA, 24 bp, Homo sapiens
gctgctgctccttcatgtgaatcc

SEQ ID NO: 11492 - DNA, 24 bp, Homo sapiens
ggagccggcgcgggagtgagccat

SEQ ID NO: 11493 - DNA, 24 bp, Homo sapiens
cggagccggcgcgggagtgagcca

SEQ ID NO: 11494 - DNA, 24 bp, Homo sapiens
ccggagccggcgcgggagtgagcc

SEQ ID NO: 11495 - DNA, 23 bp, Homo sapiens
atccgcctgcctccgcctcctaa

SEQ ID NO: 11496 - DNA, 23 bp, Homo sapiens
acctcctgaccttgtgatccgcc

SEQ ID NO: 11497 - DNA, 24 bp, Homo sapiens
ggaattacacccgtgagccatcgc

SEQ ID NO: 11498 - DNA, 24 bp, Homo sapiens
ggatataatctcttggttcgccgt

SEQ ID NO: 11499 - DNA, 24 bp, Homo sapiens
gcgagactccgtgggcgtaggacc

SEQ ID NO: 11500 - DNA, 24 bp, Homo sapiens
tttgatctcagactgctgtgctag

SEQ ID NO: 11501 - DNA, 24 bp, Homo sapiens
tagcaggcacaggttcaacaaagc

SEQ ID NO: 11502 - DNA, 24 bp, Homo sapiens
gcatccacctttcagggctttaag

SEQ ID NO: 11503 - DNA, 24 bp, Homo sapiens
tgtggcataatcagtaattggtct

SEQ ID NO: 11504 - DNA, 24 bp, Homo sapiens
gaaaggagtcttgctcgtgctggt

SEQ ID NO: 11505 - DNA, 24 bp, Homo sapiens
tatactggtgtgaatgacaaggtc

SEQ ID NO: 11506 - DNA, 24 bp, Homo sapiens
gcctgatgctggataactggaaac

SEQ ID NO: 11507 - DNA, 24 bp, Homo sapiens
tagcaggcacaggttcaacaaagc

SEQ ID NO: 11508 - DNA, 24 bp, Homo sapiens
gctgaagtaatttagcccacttaa

SEQ ID NO: 11509 - DNA, 24 bp, Homo sapiens
actatgatgataagctgtgtgaac

SEQ ID NO: 11510 - DNA, 24 bp, Homo sapiens
gaaaggagtcttgctcgtgctggt

SEQ ID NO: 11511 - DNA, 24 bp, Homo sapiens
gcctgatgctggataactggaaac

SEQ ID NO: 11512 - DNA, 24 bp, Homo sapiens
tagcacgatcttgtcagattggac

SEQ ID NO: 11513 - DNA, 24 bp, Homo sapiens
agattggacaaacagcaacaaaca

SEQ ID NO: 11514 - DNA, 24 bp, Homo sapiens
gaaaggagtcttgctcgtgctggt

SEQ ID NO: 11515 - DNA, 24 bp, Homo sapiens
gcctgatgctggataactggaaac

SEQ ID NO: 11516 - DNA, 24 bp, Homo sapiens
tgtgatggtggcttgaggtgttgg

SEQ ID NO: 11517 - DNA, 24 bp, Homo sapiens
tggagatgatccatgggtagaaca

SEQ ID NO: 11518 - DNA, 24 bp, Homo sapiens
tgttgtgatggtggcttgaggtgt

SEQ ID NO: 11519 - DNA, 24 bp, Homo sapiens
tgtgggtcgcaatgatgatgtcaa

SEQ ID NO: 11520 - DNA, 24 bp, Homo sapiens
gtgttccagttcagcctgagcagc

SEQ ID NO: 11521 - DNA, 24 bp, Homo sapiens
tgtgatggtggcttgaggtgttgg

SEQ ID NO: 11522 - DNA, 24 bp, Homo sapiens
tgtgggtcgcaatgatgatgtcaa

SEQ ID NO: 11523 - DNA, 24 bp, Homo sapiens
ggatgatgctatgtcagaacaccg

SEQ ID NO: 11524 - DNA, 24 bp, Homo sapiens
attaaagagggtggagcaggtggc

SEQ ID NO: 11525 - DNA, 24 bp, Homo sapiens
gataggacctggaatggttcagca

SEQ ID NO: 11526 - DNA, 24 bp, Homo sapiens
ggtagaggaggtaagaaaggagca

SEQ ID NO: 11527 - DNA, 24 bp, Homo sapiens
agaagacgggcaaagatgtcagga

SEQ ID NO: 11528 - DNA, 24 bp, Homo sapiens
ggagaagactttgaccagcgtgtc

SEQ ID NO: 11529 - DNA, 24 bp, Homo sapiens
gtggcggaaccttcgatgtgtctc

SEQ ID NO: 11530 - DNA, 24 bp, Homo sapiens
cacagtttttggtgagttcctaat

SEQ ID NO: 11531 - DNA, 24 bp, Homo sapiens
acacagtttttggtgagttcctaa

SEQ ID NO: 11532 - DNA, 24 bp, Homo sapiens
aacacagtttttggtgagttccta

SEQ ID NO: 11533 - DNA, 24 bp, Homo sapiens
cggatcacgaggtcaggagatcga

SEQ ID NO: 11534 - DNA, 24 bp, Homo sapiens
gcggatcacgaggtcaggagatcg

SEQ ID NO: 11535 - DNA, 24 bp, Homo sapiens
ggcggatcacgaggtcaggagatc

SEQ ID NO: 11536 - DNA, 24 bp, Homo sapiens
ggggtgctccgccctgccctcggt

SEQ ID NO: 11537 - DNA, 24 bp, Homo sapiens
tggggtgctccgccctgccctcgg

SEQ ID NO: 11538 - DNA, 24 bp, Homo sapiens
atggggtgctccgccctgccctcg

SEQ ID NO: 11539 - DNA, 24 bp, Homo sapiens
acccgccacggcctcatcgcattc

SEQ ID NO: 11540 - DNA, 24 bp, Homo sapiens
gacccgccacggcctcatcgcatt

SEQ ID NO: 11541 - DNA, 24 bp, Homo sapiens
tgacccgccacggcctcatcgcat

SEQ ID NO: 11542 - DNA, 24 bp, Homo sapiens
aatgaaaaaaggttggtttgtcca

SEQ ID NO: 11543 - DNA, 24 bp, Homo sapiens
caatgaaaaaaggttggtttgtcc

SEQ ID NO: 11544 - DNA, 24 bp, Homo sapiens
ccaatgaaaaaaggttggtttgtc

SEQ ID NO: 11545 - DNA, 24 bp, Homo sapiens
atgaaaacatggtcattgacgaga

SEQ ID NO: 11546 - DNA, 24 bp, Homo sapiens
gatgaaaacatggtcattgacgag

SEQ ID NO: 11547 - DNA, 24 bp, Homo sapiens
ggatgaaaacatggtcattgacga

SEQ ID NO: 11548 - DNA, 24 bp, Homo sapiens
aggaagagcgggaatccgtgggcc

SEQ ID NO: 11549 - DNA, 24 bp, Homo sapiens
gaggaagagcgggaatccgtgggc

SEQ ID NO: 11550 - DNA, 24 bp, Homo sapiens
cgaggaagagcgggaatccgtggg

SEQ ID NO: 11551 - DNA, 24 bp, Homo sapiens
ggatcgtggaggttgatccaatgc

SEQ ID NO: 11552 - DNA, 24 bp, Homo sapiens
gggatcgtggaggttgatccaatg

SEQ ID NO: 11553 - DNA, 24 bp, Homo sapiens
cgggatcgtggaggttgatccaat

SEQ ID NO: 11554 - DNA, 24 bp, Homo sapiens
tagtcaaagaggcatgtctgactc

SEQ ID NO: 11555 - DNA, 24 bp, Homo sapiens
gtagtcaaagaggcatgtctgact

SEQ ID NO: 11556 - DNA, 24 bp, Homo sapiens
ggtagtcaaagaggcatgtctgac

SEQ ID NO: 11557 - DNA, 24 bp, Homo sapiens
ttagccaggatggtctcggtctcc

SEQ ID NO: 11558 - DNA, 24 bp, Homo sapiens
tcccaaagtgctgagattataggc

SEQ ID NO: 11559 - DNA, 24 bp, Homo sapiens
catcgcgcccagcccgtgtgttta

SEQ ID NO: 11560 - DNA, 24 bp, Homo sapiens
cagccggagttgtaccacccaatg

SEQ ID NO: 11561 - DNA, 23 bp, Homo sapiens
ggactgatcggtgccgaagagaa

SEQ ID NO: 11562 - DNA, 24 bp, Homo sapiens
caggatttgctgttgctgagcctc

SEQ ID NO: 11563 - DNA, 24 bp, Homo sapiens
ccggctacatcgaggctcttgcag

SEQ ID NO: 11564 - DNA, 24 bp, Homo sapiens
aggctcctgcttctgctgctggtg

SEQ ID NO: 11565 - DNA, 24 bp, Homo sapiens
tctcctgacctcgtgatccgccca

SEQ ID NO: 11566 - DNA, 24 bp, Homo sapiens
tcccaaagtgctgagattataggc

SEQ ID NO: 11567 - DNA, 24 bp, Homo sapiens
catcgcgcccagcccgtgtgttta

SEQ ID NO: 11568 - DNA, 24 bp, Homo sapiens
cttcagcctcattcactgtcctgg

SEQ ID NO: 11569 - DNA, 24 bp, Homo sapiens
acttatatgcaggctgtcgttccg

SEQ ID NO: 11570 - DNA, 24 bp, Homo sapiens
tgaagtccagtgtttccacggctg

SEQ ID NO: 11571 - DNA, 24 bp, Homo sapiens
tttctccaaaggcactgaccctcg

SEQ ID NO: 11572 - DNA, 24 bp, Homo sapiens
actttgtcccctcacctccacccc

SEQ ID NO: 11573 - DNA, 24 bp, Homo sapiens
caccggccttgtgacattcactca

SEQ ID NO: 11574 - DNA, 24 bp, Homo sapiens
ggtgccgaagagaaagtgattaac

SEQ ID NO: 11575 - DNA, 24 bp, Homo sapiens
acatggtcattgacgagactctgg

SEQ ID NO: 11576 - DNA, 24 bp, Homo sapiens
aggaaatgattttcaatgccgaga

SEQ ID NO: 11577 - DNA, 24 bp, Homo sapiens
ctgcgtctgacatcctgacctcct

SEQ ID NO: 11578 - DNA, 24 bp, Homo sapiens
aagagcgtcacctgaacaagatgc

SEQ ID NO: 11579 - DNA, 24 bp, Homo sapiens
tgaggaagaggcagtatggcacca

SEQ ID NO: 11580 - DNA, 24 bp, Homo sapiens
atctggagtgggagagcaggatgg

SEQ ID NO: 11581 - DNA, 24 bp, Homo sapiens
tgacgagactctggatgttaagga

SEQ ID NO: 11582 - DNA, 24 bp, Homo sapiens
tttcaatgccgagagagttggagg

SEQ ID NO: 11583 - DNA, 24 bp, Homo sapiens
cggtgccgaagagaaagtgattaa

SEQ ID NO: 11584 - DNA, 24 bp, Homo sapiens
attttcaatgccgagagagttgga

SEQ ID NO: 11585 - DNA, 24 bp, Homo sapiens
ggacttcagtctgagtagcagtgc

SEQ ID NO: 11586 - DNA, 24 bp, Homo sapiens
ccattgccacggtcatcgtcatca

SEQ ID NO: 11587 - DNA, 24 bp, Homo sapiens
tgaggaagaggcagtatggcacca

SEQ ID NO: 11588 - DNA, 24 bp, Homo sapiens
gaggaagaggcagtatggcaccat

SEQ ID NO: 11589 - DNA, 24 bp, Homo sapiens
ggacttcagtctgagtagcagtgc

SEQ ID NO: 11590 - DNA, 24 bp, Homo sapiens
cacggtcatcgtcatcagcctggt

SEQ ID NO: 11591 - DNA, 24 bp, Homo sapiens
agaaggtggagccgctgcgcgcag

SEQ ID NO: 11592 - DNA, 24 bp, Homo sapiens
cagaaggtggagccgctgcgcgca

SEQ ID NO: 11593 - DNA, 24 bp, Homo sapiens
ccagaaggtggagccgctgcgcgc

SEQ ID NO: 11594 - DNA, 24 bp, Homo sapiens
ggctgtcgccgtgccctcttccag

SEQ ID NO: 11595 - DNA, 24 bp, Homo sapiens
tggctgtcgccgtgccctcttcca

SEQ ID NO: 11596 - DNA, 24 bp, Homo sapiens
gtggctgtcgccgtgccctcttcc

SEQ ID NO: 11597 - DNA, 24 bp, Homo sapiens
cacacctacatgtgagttcagaaa

SEQ ID NO: 11598 - DNA, 24 bp, Homo sapiens
acacacctacatgtgagttcagaa

SEQ ID NO: 11599 - DNA, 24 bp, Homo sapiens
tacacacctacatgtgagttcaga

SEQ ID NO: 11600 - DNA, 24 bp, Homo sapiens
gctgccgagtcctatgattacacg

SEQ ID NO: 11601 - DNA, 24 bp, Homo sapiens
gcctacaagcatcacagtcccatc

SEQ ID NO: 11602 - DNA, 24 bp, Homo sapiens
agccatgcctaactgacttcttga

SEQ ID NO: 11603 - DNA, 24 bp, Homo sapiens
ctactaaagaggctgaggcaggag

SEQ ID NO: 11604 - DNA, 24 bp, Homo sapiens
gctactaaagaggctgaggcagga

SEQ ID NO: 11605 - DNA, 24 bp, Homo sapiens
agctactaaagaggctgaggcagg

SEQ ID NO: 11606 - DNA, 25 bp, Homo sapiens
gccacctcctccaactcaacaacat

SEQ ID NO: 11607 - DNA, 23 bp, Homo sapiens
gagcctcaagacaccttccgagt

SEQ ID NO: 11608 - DNA, 25 bp, Homo sapiens
agcggatgataatctcaagacacct

SEQ ID NO: 11609 - DNA, 24 bp, Homo sapiens
cccttccgcagccatcgagttgat

SEQ ID NO: 11610 - DNA, 24 bp, Homo sapiens
gcccttccgcagccatcgagttga

SEQ ID NO: 11611 - DNA, 24 bp, Homo sapiens
tgcccttccgcagccatcgagttg

SEQ ID NO: 11612 - DNA, 23 bp, Homo sapiens
catcgccgaggagctgctgtacc

SEQ ID NO: 11613 - DNA, 23 bp, Homo sapiens
aacacggaccacagcaacagcca

SEQ ID NO: 11614 - DNA, 23 bp, Homo sapiens
tggtgcgtggcctaatggccgcc

SEQ ID NO: 11615 - DNA, 25 bp, Homo sapiens
tgtgatctcagttcgctgcaacctc

SEQ ID NO: 11616 - DNA, 25 bp, Homo sapiens
tgattcttctgcctcatcctcctga

SEQ ID NO: 11617 - DNA, 23 bp, Homo sapiens
aggtgtgaggtatcatgcctggc

SEQ ID NO: 11618 - DNA, 24 bp, Homo sapiens
gcgcggaggaggattccaaggtgt

SEQ ID NO: 11619 - DNA, 24 bp, Homo sapiens
agcgcggaggaggattccaaggtg

SEQ ID NO: 11620 - DNA, 24 bp, Homo sapiens
cagcgcggaggaggattccaaggt

SEQ ID NO: 11621 - DNA, 24 bp, Homo sapiens
acgcctcacagagtatgacattgc

SEQ ID NO: 11622 - DNA, 24 bp, Homo sapiens
tacgcctcacagagtatgacattg

SEQ ID NO: 11623 - DNA, 24 bp, Homo sapiens
ctacgcctcacagagtatgacatt

SEQ ID NO: 11624 - DNA, 24 bp, Homo sapiens
caattctcctgcctcagcctcctg

SEQ ID NO: 11625 - DNA, 24 bp, Homo sapiens
tgatcttggctcatggcaacctcc

SEQ ID NO: 11626 - DNA, 24 bp, Homo sapiens
cctcccagacgaagcctccaacta

SEQ ID NO: 11627 - DNA, 24 bp, Homo sapiens
gcacccactgacaagagacctcca

SEQ ID NO: 11628 - DNA, 24 bp, Homo sapiens
actttacccactggaagctgctca

SEQ ID NO: 11629 - DNA, 24 bp, Homo sapiens
cacctgcccaggcccctgtgactc

SEQ ID NO: 11630 - DNA, 24 bp, Homo sapiens
ccacctgcccaggcccctgtgact

SEQ ID NO: 11631 - DNA, 24 bp, Homo sapiens
accacctgcccaggcccctgtgac

SEQ ID NO: 11632 - DNA, 24 bp, Homo sapiens
ttccctgctgtcctccgtccgcta

SEQ ID NO: 11633 - DNA, 24 bp, Homo sapiens
tttccctgctgtcctccgtccgct

SEQ ID NO: 11634 - DNA, 24 bp, Homo sapiens
atttccctgctgtcctccgtccgc

SEQ ID NO: 11635 - DNA, 24 bp, Homo sapiens
cgcctcttgagtgctttggacgat

SEQ ID NO: 11636 - DNA, 25 bp, Homo sapiens
gtgtgccgtatggtccaattcctgt

SEQ ID NO: 11637 - DNA, 23 bp, Homo sapiens
ggacatcaggcaacgggaagacg

SEQ ID NO: 11638 - DNA, 23 bp, Homo sapiens
tttcccacgctggctggacttgc

SEQ ID NO: 11639 - DNA, 23 bp, Homo sapiens
acgttgagctgtgcagagaaggc

SEQ ID NO: 11640 - DNA, 23 bp, Homo sapiens
gttccacctcgctgccccgttcc

SEQ ID NO: 11641 - DNA, 24 bp, Homo sapiens
aacatcagtgtgccgtatggtcca

SEQ ID NO: 11642 - DNA, 23 bp, Homo sapiens
ggacatcaggcaacgggaagacg

SEQ ID NO: 11643 - DNA, 23 bp, Homo sapiens
cccttggagaacatcaccctggc

SEQ ID NO: 11644 - DNA, 23 bp, Homo sapiens
cccttggagaacatcaccctggc

SEQ ID NO: 11645 - DNA, 23 bp, Homo sapiens
ggacatcaggcaacgggaagacg

SEQ ID NO: 11646 - DNA, 25 bp, Homo sapiens
gtgtgccgtatggtccaattcctgt

SEQ ID NO: 11647 - DNA, 24 bp, Homo sapiens
cgcctcttgagtgctttggacgat

SEQ ID NO: 11648 - DNA, 25 bp, Homo sapiens
ggctctaggtgaacatggagaatgg

SEQ ID NO: 11649 - DNA, 24 bp, Homo sapiens
ttgattccgcctcacagttgatgg

SEQ ID NO: 11650 - DNA, 24 bp, Homo sapiens
ttgattccgcctcacagttgatgg

SEQ ID NO: 11651 - DNA, 25 bp, Homo sapiens
tggaccttgtggaacttgtgtctct

SEQ ID NO: 11652 - DNA, 23 bp, Homo sapiens
acgttgagctgtgcagagaaggc

SEQ ID NO: 11653 - DNA, 24 bp, Homo sapiens
ccgggaggcagaggttgcagtgag

SEQ ID NO: 11654 - DNA, 24 bp, Homo sapiens
cccgggaggcagaggttgcagtga

SEQ ID NO: 11655 - DNA, 24 bp, Homo sapiens
acccgggaggcagaggttgcagtg

SEQ ID NO: 11656 - DNA, 24 bp, Homo sapiens
ggactacaggcgcacaccaccacg

SEQ ID NO: 11657 - DNA, 24 bp, Homo sapiens
aattctcctgcctcagccccccta

SEQ ID NO: 11658 - DNA, 24 bp, Homo sapiens
tgaaattacaggtgtgagccaccg

SEQ ID NO: 11659 - DNA, 24 bp, Homo sapiens
atgaaattacaggtgtgagccacc

SEQ ID NO: 11660 - DNA, 24 bp, Homo sapiens
aatgaaattacaggtgtgagccac

SEQ ID NO: 11661 - DNA, 25 bp, Homo sapiens
ttcaagcggttctcatgtctcagcc

SEQ ID NO: 11662 - DNA, 25 bp, Homo sapiens
tctcatctcagtgcaacctccacct

SEQ ID NO: 11663 - DNA, 24 bp, Homo sapiens
gtcctccccagcaagcgagcctga

SEQ ID NO: 11664 - DNA, 24 bp, Homo sapiens
ggtcctccccagcaagcgagcctg

SEQ ID NO: 11665 - DNA, 24 bp, Homo sapiens
cggtcctccccagcaagcgagcct

SEQ ID NO: 11666 - DNA, 24 bp, Homo sapiens
ggctgaggcaggagaatggcgtga

SEQ ID NO: 11667 - DNA, 24 bp, Homo sapiens
aggctgaggcaggagaatggcgtg

SEQ ID NO: 11668 - DNA, 24 bp, Homo sapiens
gaggctgaggcaggagaatggcgt

SEQ ID NO: 11669 - DNA, 24 bp, Homo sapiens
ggctgaggcaggagaatcgcttga

SEQ ID NO: 11670 - DNA, 24 bp, Homo sapiens
aggctgaggcaggagaatcgcttg

SEQ ID NO: 11671 - DNA, 24 bp, Homo sapiens
gaggctgaggcaggagaatcgctt

SEQ ID NO: 11672 - DNA, 24 bp, Homo sapiens
gccagaaaacagaaaatgtttcaa

SEQ ID NO: 11673 - DNA, 24 bp, Homo sapiens
cgccagaaaacagaaaatgtttca

SEQ ID NO: 11674 - DNA, 24 bp, Homo sapiens
cgccagaaaacagaaaatgtttca

SEQ ID NO: 11675 - DNA, 24 bp, Homo sapiens
acaaatgcaaaatccccccttctg

SEQ ID NO: 11676 - DNA, 24 bp, Homo sapiens
cacaaatgcaaaatccccccttct

SEQ ID NO: 11677 - DNA, 24 bp, Homo sapiens
cacaaatgcaaaatccccccttct

SEQ ID NO: 11678 - DNA, 24 bp, Homo sapiens
tttgcaactgggtcagaatggcgg

SEQ ID NO: 11679 - DNA, 24 bp, Homo sapiens
ctttgcaactgggtcagaatggcg

SEQ ID NO: 11680 - DNA, 24 bp, Homo sapiens
ctttgcaactgggtcagaatggcg

SEQ ID NO: 11681 - DNA, 24 bp, Homo sapiens
tccaccctcagtggatgataatct

SEQ ID NO: 11682 - DNA, 24 bp, Homo sapiens
ttccaccctcagtggatgataatc

SEQ ID NO: 11683 - DNA, 24 bp, Homo sapiens
ttccaccctcagtggatgataatc

SEQ ID NO: 11684 - DNA, 24 bp, Homo sapiens
agcggatgataatctcaagacacc

SEQ ID NO: 11685 - DNA, 24 bp, Homo sapiens
gtcagctcactccccttccaccct

SEQ ID NO: 11686 - DNA, 24 bp, Homo sapiens
caccctcagcagatgataatatca

SEQ ID NO: 11687 - DNA, 24 bp, Homo sapiens
ctcaagacaccttccgagcgtcag

SEQ ID NO: 11688 - DNA, 24 bp, Homo sapiens
aatatcaagacacctgccgagcgt

SEQ ID NO: 11689 - DNA, 24 bp, Homo sapiens
cttccaccctcagctccaccctca

SEQ ID NO: 11690 - DNA, 24 bp, Homo sapiens
aatatcaagacacctgccgagcgt

SEQ ID NO: 11691 - DNA, 24 bp, Homo sapiens
aatctcaagacaccttccgagcgt

SEQ ID NO: 11692 - DNA, 24 bp, Homo sapiens
cttccaccctcagctccaccctca

SEQ ID NO: 11693 - DNA, 24 bp, Homo sapiens
accctcagcagatgataatatcaa

SEQ ID NO: 11694 - DNA, 24 bp, Homo sapiens
caccctcagcagatgataatatca

SEQ ID NO: 11695 - DNA, 24 bp, Homo sapiens
ccaccctcagcagatgataatatc

SEQ ID NO: 11696 - DNA, 24 bp, Homo sapiens
aatctcaagacaccttccgagcgt

SEQ ID NO: 11697 - DNA, 24 bp, Homo sapiens
aatatcaagacacctgccgagcgt

SEQ ID NO: 11698 - DNA, 24 bp, Homo sapiens
aatctcaagacaccttccgagcgt

SEQ ID NO: 11699 - DNA, 24 bp, Homo sapiens
aatctcaagacaccttccgagcgt

SEQ ID NO: 11700 - DNA, 24 bp, Homo sapiens
aatctcaagacaccttccgagcgt

SEQ ID NO: 11701 - DNA, 24 bp, Homo sapiens
cttccaccctcagctccaccctca

SEQ ID NO: 11702 - DNA, 24 bp, Homo sapiens
aatctcaagacaccttccgagcgt

SEQ ID NO: 11703 - DNA, 24 bp, Homo sapiens
atacctgctgagcgtctgcggatt

SEQ ID NO: 11704 - DNA, 24 bp, Homo sapiens
cttccaccctcagctccaccctca

SEQ ID NO: 11705 - DNA, 24 bp, Homo sapiens
ttccaccctcagcggatgataatc

SEQ ID NO: 11706 - DNA, 24 bp, Homo sapiens
caccttccgagcgtcagctcactc

SEQ ID NO: 11707 - DNA, 24 bp, Homo sapiens
caccctcagctccaccctcagcag

SEQ ID NO: 11708 - DNA, 24 bp, Homo sapiens
tctcaagacacctcctgagtgtct

SEQ ID NO: 11709 - DNA, 24 bp, Homo sapiens
atctcaagacacctcctgagtgtc

SEQ ID NO: 11710 - DNA, 24 bp, Homo sapiens
aatctcaagacacctcctgagtgt

SEQ ID NO: 11711 - DNA, 24 bp, Homo sapiens
tctcaagacacctcccgagtgtct

SEQ ID NO: 11712 - DNA, 24 bp, Homo sapiens
atctcaagacacctcccgagtgtc

SEQ ID NO: 11713 - DNA, 24 bp, Homo sapiens
aatctcaagacacctcccgagtgt

SEQ ID NO: 11714 - DNA, 24 bp, Homo sapiens
agcggatgataatctcaagacacc

SEQ ID NO: 11715 - DNA, 24 bp, Homo sapiens
gccacctcctccaactcaacaaca

SEQ ID NO: 11716 - DNA, 24 bp, Homo sapiens
gcagcggagcatcgtcattcttca

SEQ ID NO: 11717 - DNA, 24 bp, Homo sapiens
agcggatgataatctcaagacacc

SEQ ID NO: 11718 - DNA, 24 bp, Homo sapiens
tgctcactccccttccaccctcag

SEQ ID NO: 11719 - DNA, 24 bp, Homo sapiens
cctcaagacacctcccgagtgtct

SEQ ID NO: 11720 - DNA, 24 bp, Homo sapiens
gcctcaagacacctcccgagtgtc

SEQ ID NO: 11721 - DNA, 24 bp, Homo sapiens
agcctcaagacacctcccgagtgt

SEQ ID NO: 11722 - DNA, 24 bp, Homo sapiens
catcgtcattcttcaggattgccc

SEQ ID NO: 11723 - DNA, 24 bp, Homo sapiens
aacaacattctataactgataact

SEQ ID NO: 11724 - DNA, 24 bp, Homo sapiens
ggatgggccaccagccacctcctc

SEQ ID NO: 11725 - DNA, 24 bp, Homo sapiens
cctcaagacacctcccgagtgtgt

SEQ ID NO: 11726 - DNA, 24 bp, Homo sapiens
gcctcaagacacctcccgagtgtg

SEQ ID NO: 11727 - DNA, 24 bp, Homo sapiens
agcctcaagacacctcccgagtgt

SEQ ID NO: 11728 - DNA, 24 bp, Homo sapiens
ccttccaccctcagctctaccctc

SEQ ID NO: 11729 - DNA, 24 bp, Homo sapiens
agcggatgataatctcaagacacg

SEQ ID NO: 11730 - DNA, 24 bp, Homo sapiens
aatctcaagacaccttccgagcgt

SEQ ID NO: 11731 - DNA, 24 bp, Homo sapiens
gcagcagcatgtaaagtcagtgac

SEQ ID NO: 11732 - DNA, 24 bp, Homo sapiens
tttctgaagcccttgaccactata

SEQ ID NO: 11733 - DNA, 24 bp, Homo sapiens
tgaagctctctattgtcctgaccc

SEQ ID NO: 11734 - DNA, 24 bp, Homo sapiens
gaccccacagtttcctgtcccatg

SEQ ID NO: 11735 - DNA, 24 bp, Homo sapiens
tgaccccacagtttcctgtcccat

SEQ ID NO: 11736 - DNA, 24 bp, Homo sapiens
ctgaccccacagtttcctgtccca

SEQ ID NO: 11737 - DNA, 24 bp, Homo sapiens
gctcactacaacctccgcatcctg

SEQ ID NO: 11738 - DNA, 24 bp, Homo sapiens
ggttcaagcgattctcctgcctca

SEQ ID NO: 11739 - DNA, 24 bp, Homo sapiens
agcagttctcctgtctcagcctcc

SEQ ID NO: 11740 - DNA, 24 bp, Homo sapiens
atgcccatgcgagtacctgaggaa

SEQ ID NO: 11741 - DNA, 24 bp, Homo sapiens
ccctgttctcattctgcaaatggt

SEQ ID NO: 11742 - DNA, 24 bp, Homo sapiens
attgtcctgaccccacagttcctg

SEQ ID NO: 11743 - DNA, 24 bp, Homo sapiens
ccactgcctctgtgcctgcctgta

SEQ ID NO: 11744 - DNA, 24 bp, Homo sapiens
gcagcagcatgtaaagtcagtgac

SEQ ID NO: 11745 - DNA, 24 bp, Homo sapiens
ccatgaccagggccagctcaccaa

SEQ ID NO: 11746 - DNA, 24 bp, Homo sapiens
tgaagctctctattgtcctgaccc

SEQ ID NO: 11747 - DNA, 24 bp, Homo sapiens
atcaatggaaagaggaagaccgcc

SEQ ID NO: 11748 - DNA, 24 bp, Homo sapiens
gcggcgagcagaggactaccacaa

SEQ ID NO: 11749 - DNA, 24 bp, Homo sapiens
gcagcggagcatcgtcattcttca

SEQ ID NO: 11750 - DNA, 24 bp, Homo sapiens
gcggcgagcagaggactaccacaa

SEQ ID NO: 11751 - DNA, 24 bp, Homo sapiens
gcagcggagcatcgtcattcttca

SEQ ID NO: 11752 - DNA, 24 bp, Homo sapiens
gccacctcctccaactcaacaaca

SEQ ID NO: 11753 - DNA, 24 bp, Homo sapiens
gcagcggagcatcgtcattcttca

SEQ ID NO: 11754 - DNA, 24 bp, Homo sapiens
gccacctcctccaactcaacaaca

SEQ ID NO: 11755 - DNA, 24 bp, Homo sapiens
agcggatgataatctcaagacacc

SEQ ID NO: 11756 - DNA, 24 bp, Homo sapiens
gagcatcgtcattcttcaggattg

SEQ ID NO: 11757 - DNA, 24 bp, Homo sapiens
gccacctcctccaactcaacaaca

SEQ ID NO: 11758 - DNA, 24 bp, Homo sapiens
agcggatgataatctcaagacacg

SEQ ID NO: 11759 - DNA, 24 bp, Homo sapiens
gccacctcctccaactcaacaaca

SEQ ID NO: 11760 - DNA, 24 bp, Homo sapiens
gagcatcgtcattcttcaggattg

SEQ ID NO: 11761 - DNA, 24 bp, Homo sapiens
agcggatgataatctcaagacacc

SEQ ID NO: 11762 - DNA, 24 bp, Homo sapiens
tctcaagacacctcccgagtgtct

SEQ ID NO: 11763 - DNA, 24 bp, Homo sapiens
atctcaagacacctcccgagtgtc

SEQ ID NO: 11764 - DNA, 24 bp, Homo sapiens
aatctcaagacacctcccgagtgt

SEQ ID NO: 11765 - DNA, 24 bp, Homo sapiens
aatatcaagacacctgccgagcgt

SEQ ID NO: 11766 - DNA, 24 bp, Homo sapiens
atacctgctgagcgtctgcggatt

SEQ ID NO: 11767 - DNA, 24 bp, Homo sapiens
aatctcaagacaccttccgagcgt

SEQ ID NO: 11768 - DNA, 24 bp, Homo sapiens
aatctcaagacaccttccgagcgt

SEQ ID NO: 11769 - DNA, 24 bp, Homo sapiens
aatatcaagacacctgccgagcgt

SEQ ID NO: 11770 - DNA, 24 bp, Homo sapiens
aatatcaagacacctgccgagcgt

SEQ ID NO: 11771 - DNA, 24 bp, Homo sapiens
ctcctgcgtcagcctcctgagtag

SEQ ID NO: 11772 - DNA, 24 bp, Homo sapiens
ctacaacctccgcctccccagttc

SEQ ID NO: 11773 - DNA, 24 bp, Homo sapiens
ccaccacacctggctaatttttgt

SEQ ID NO: 11774 - DNA, 24 bp, Homo sapiens
atgcaagccaggtaaaaattttaa

SEQ ID NO: 11775 - DNA, 24 bp, Homo sapiens
tatgcaagccaggtaaaaatttta

SEQ ID NO: 11776 - DNA, 24 bp, Homo sapiens
gtatgcaagccaggtaaaaatttt

SEQ ID NO: 11777 - DNA, 24 bp, Homo sapiens
gtggcaaaaagtgatgagaagact

SEQ ID NO: 11778 - DNA, 24 bp, Homo sapiens
ggtggcaaaaagtgatgagaagac

SEQ ID NO: 11779 - DNA, 24 bp, Homo sapiens
aggtggcaaaaagtgatgagaaga

SEQ ID NO: 11780 - DNA, 24 bp, Homo sapiens
gtgtgagcatgggaacgcctaagc

SEQ ID NO: 11781 - DNA, 24 bp, Homo sapiens
ggtgtgagcatgggaacgcctaag

SEQ ID NO: 11782 - DNA, 24 bp, Homo sapiens
aggtgtgagcatgggaacgcctaa

SEQ ID NO: 11783 - DNA, 24 bp, Homo sapiens
tcagggtttcagcggatgagcgtc

SEQ ID NO: 11784 - DNA, 24 bp, Homo sapiens
ccgcaggtaacgatgggaaaggaa

SEQ ID NO: 11785 - DNA, 24 bp, Homo sapiens
cacggaatacgcctgtgttaagga

SEQ ID NO: 11786 - DNA, 24 bp, Homo sapiens
attcggatggagacctcaccttga

SEQ ID NO: 11787 - DNA, 24 bp, Homo sapiens
agcagcaggaagataccacaatca

SEQ ID NO: 11788 - DNA, 24 bp, Homo sapiens
tccatagacctcacaccacttgcc

SEQ ID NO: 11789 - DNA, 24 bp, Homo sapiens
caccgacctggctggaaatgagta

SEQ ID NO: 11790 - DNA, 24 bp, Homo sapiens
cttggacggctgttgacacctctg

SEQ ID NO: 11791 - DNA, 24 bp, Homo sapiens
gggtcttgcttagtgtcagaaggc

SEQ ID NO: 11792 - DNA, 24 bp, Homo sapiens
cttggacggctgttgacacctctg

SEQ ID NO: 11793 - DNA, 24 bp, Homo sapiens
gggtcttgcttagtgtcagaaggc

SEQ ID NO: 11794 - DNA, 24 bp, Homo sapiens
gcggcgaatggatctttgagcatc

SEQ ID NO: 11795 - DNA, 24 bp, Homo sapiens
cttggacggctgttgacacctctg

SEQ ID NO: 11796 - DNA, 24 bp, Homo sapiens
caccgacctggctggaaatgagta

SEQ ID NO: 11797 - DNA, 24 bp, Homo sapiens
tgtccacagagggcttcatcactc

SEQ ID NO: 11798 - DNA, 24 bp, Homo sapiens
ccggtggcgcgggctggcgcgagc

SEQ ID NO: 11799 - DNA, 24 bp, Homo sapiens
gccggtggcgcgggctggcgcgag

SEQ ID NO: 11800 - DNA, 24 bp, Homo sapiens
cgccggtggcgcgggctggcgcga

SEQ ID NO: 11801 - DNA, 24 bp, Homo sapiens
gggaggctgaggcaggagaattgc

SEQ ID NO: 11802 - DNA, 24 bp, Homo sapiens
tgggaggctgaggcaggagaattg

SEQ ID NO: 11803 - DNA, 24 bp, Homo sapiens
ttgggaggctgaggcaggagaatt

SEQ ID NO: 11804 - DNA, 23 bp, Homo sapiens
ctcctgcctcccagccttctctc

SEQ ID NO: 11805 - DNA, 24 bp, Homo sapiens
ctcatgcttcttggcagcctctcc

SEQ ID NO: 11806 - DNA, 23 bp, Homo sapiens
tcctgcctcccagtgcctctttc

SEQ ID NO: 11807 - DNA, 24 bp, Homo sapiens
tccacaggcacagctccatcgtta

SEQ ID NO: 11808 - DNA, 24 bp, Homo sapiens
ctccacaggcacagctccatcgtt

SEQ ID NO: 11809 - DNA, 24 bp, Homo sapiens
cctccacaggcacagctccatcgt

SEQ ID NO: 11810 - DNA, 24 bp, Homo sapiens
accgtgcccaggtaagccagccca

SEQ ID NO: 11811 - DNA, 24 bp, Homo sapiens
caccgtgcccaggtaagccagccc

SEQ ID NO: 11812 - DNA, 24 bp, Homo sapiens
ccaccgtgcccaggtaagccagcc

SEQ ID NO: 11813 - DNA, 24 bp, Homo sapiens
gaggcgcaagggtaggaggcaggg

SEQ ID NO: 11814 - DNA, 24 bp, Homo sapiens
tgaggcgcaagggtaggaggcagg

SEQ ID NO: 11815 - DNA, 24 bp, Homo sapiens
atgaggcgcaagggtaggaggcag

SEQ ID NO: 11816 - DNA, 24 bp, Homo sapiens
gctccttgctgctcttcaacacca

SEQ ID NO: 11817 - DNA, 23 bp, Homo sapiens
caggtgttctccagtgccaagta

SEQ ID NO: 11818 - DNA, 25 bp, Homo sapiens
gcaggaatatggctccatcttcacg

SEQ ID NO: 11819 - DNA, 24 bp, Homo sapiens
tttcctcccagtatttgttcccgt

SEQ ID NO: 11820 - DNA, 24 bp, Homo sapiens
atttcctcccagtatttgttcccg

SEQ ID NO: 11821 - DNA, 24 bp, Homo sapiens
catttcctcccagtatttgttccc

SEQ ID NO: 11822 - DNA, 24 bp, Homo sapiens
ttcctcctcggcctcgtcacgtgt

SEQ ID NO: 11823 - DNA, 24 bp, Homo sapiens
gttcctcctcggcctcgtcacgtg

SEQ ID NO: 11824 - DNA, 24 bp, Homo sapiens
tgttcctcctcggcctcgtcacgt

SEQ ID NO: 11825 - DNA, 24 bp, Homo sapiens
ttgacctggagaagtacagcgagc

SEQ ID NO: 11826 - DNA, 24 bp, Homo sapiens
agttggatttcttcaaaaccagca

SEQ ID NO: 11827 - DNA, 24 bp, Homo sapiens
tggcttccatgtctcagcagctca

SEQ ID NO: 11828 - DNA, 24 bp, Homo sapiens
tgaaccactgtttggagcacttgg

SEQ ID NO: 11829 - DNA, 24 bp, Homo sapiens
agctagaactgaactggaacaaca

SEQ ID NO: 11830 - DNA, 24 bp, Homo sapiens
aacctaacacttcacaaactgagt

SEQ ID NO: 11831 - DNA, 24 bp, Homo sapiens
cttctccacaagcgccttcggtcc

SEQ ID NO: 11832 - DNA, 24 bp, Homo sapiens
ccttctccacaagcgccttcggtc

SEQ ID NO: 11833 - DNA, 24 bp, Homo sapiens
tccttctccacaagcgccttcggt

SEQ ID NO: 11834 - DNA, 24 bp, Homo sapiens
tccacgccgagacaagcagatgcc

SEQ ID NO: 11835 - DNA, 24 bp, Homo sapiens
gtccacgccgagacaagcagatgc

SEQ ID NO: 11836 - DNA, 24 bp, Homo sapiens
agtccacgccgagacaagcagatg

SEQ ID NO: 11837 - DNA, 24 bp, Homo sapiens
ggagagccagccagagaaggagag

SEQ ID NO: 11838 - DNA, 24 bp, Homo sapiens
gcacatctgagcagttctactcgc

SEQ ID NO: 11839 - DNA, 24 bp, Homo sapiens
cagggagatcgtggggaaggataa

SEQ ID NO: 11840 - DNA, 24 bp, Homo sapiens
cctggtggaggtgcagctgagcgg

SEQ ID NO: 11841 - DNA, 24 bp, Homo sapiens
gacgctgagcggtcgcgccatgga

SEQ ID NO: 11842 - DNA, 24 bp, Homo sapiens
ctcggagcctcccttgcgatccca

SEQ ID NO: 11843 - DNA, 24 bp, Homo sapiens
ggagagccagccagagaaggagag

SEQ ID NO: 11844 - DNA, 24 bp, Homo sapiens
gcacatctgagcagttctactcgc

SEQ ID NO: 11845 - DNA, 24 bp, Homo sapiens
cactatggacttgatggaaggcat

SEQ ID NO: 11846 - DNA, 24 bp, Homo sapiens
gccaccaattctacctactacagc

SEQ ID NO: 11847 - DNA, 24 bp, Homo sapiens
agcagcaggagcacgaagaggatt

SEQ ID NO: 11848 - DNA, 24 bp, Homo sapiens
cggatgttcattggagacctggac

SEQ ID NO: 11849 - DNA, 24 bp, Homo sapiens
agcagcaggagcacgaagaggatt

SEQ ID NO: 11850 - DNA, 24 bp, Homo sapiens
tacctactacagcacgtcggcccc

SEQ ID NO: 11851 - DNA, 24 bp, Homo sapiens
gcctgcggccgtgtccctggccac

SEQ ID NO: 11852 - DNA, 24 bp, Homo sapiens
cccccatgcaggtgagctcctgtt

SEQ ID NO: 11853 - DNA, 24 bp, Homo sapiens
acccccatgcaggtgagctcctgt

SEQ ID NO: 11854 - DNA, 24 bp, Homo sapiens
cacccccatgcaggtgagctcctg

SEQ ID NO: 11855 - DNA, 23 bp, Homo sapiens
ccgctggctcagtgtcacctggc

SEQ ID NO: 11856 - DNA, 23 bp, Homo sapiens
aacatcacagtcactgccgtggc

SEQ ID NO: 11857 - DNA, 25 bp, Homo sapiens
cagatatcgggctgaacggtcaaag

SEQ ID NO: 11858 - DNA, 23 bp, Homo sapiens
tacagccctggtgtctgcctcct

SEQ ID NO: 11859 - DNA, 23 bp, Homo sapiens
cagtatgggcagccaggcaggtc

SEQ ID NO: 11860 - DNA, 23 bp, Homo sapiens
gtgttgtcctggagtgactgccg

SEQ ID NO: 11861 - DNA, 24 bp, Homo sapiens
cgcgcctacggaaactcagccacc

SEQ ID NO: 11862 - DNA, 24 bp, Homo sapiens
ccgcgcctacggaaactcagccac

SEQ ID NO: 11863 - DNA, 24 bp, Homo sapiens
gccgcgcctacggaaactcagcca

SEQ ID NO: 11864 - DNA, 24 bp, Homo sapiens
tctaaccttagaaaatagctccgg

SEQ ID NO: 11865 - DNA, 24 bp, Homo sapiens
ttctaaccttagaaaatagctccg

SEQ ID NO: 11866 - DNA, 24 bp, Homo sapiens
tttctaaccttagaaaatagctcc

SEQ ID NO: 11867 - DNA, 24 bp, Homo sapiens
aacttcccgtggtaagttttagaa

SEQ ID NO: 11868 - DNA, 24 bp, Homo sapiens
taacttcccgtggtaagttttaga

SEQ ID NO: 11869 - DNA, 24 bp, Homo sapiens
ttaacttcccgtggtaagttttag

SEQ ID NO: 11870 - DNA, 24 bp, Homo sapiens
aatgagtataggctcaagattatt

SEQ ID NO: 11871 - DNA, 24 bp, Homo sapiens
aaatgagtataggctcaagattat

SEQ ID NO: 11872 - DNA, 24 bp, Homo sapiens
gaaatgagtataggctcaagatta

SEQ ID NO: 11873 - DNA, 24 bp, Homo sapiens
catgcctcatcctcccaaagtgct

SEQ ID NO: 11874 - DNA, 24 bp, Homo sapiens
tcatgcctcatcctcccaaagtgc

SEQ ID NO: 11875 - DNA, 24 bp, Homo sapiens
ctcatgcctcatcctcccaaagtg

SEQ ID NO: 11876 - DNA, 25 bp, Homo sapiens
ctcacggaagccaaggaagacgatg

SEQ ID NO: 11877 - DNA, 25 bp, Homo sapiens
tcagtctggtcagtccgttatctcc

SEQ ID NO: 11878 - DNA, 25 bp, Homo sapiens
ggaggtgaaggttctggatgaagca

SEQ ID NO: 11879 - DNA, 25 bp, Homo sapiens
gcatctccaacatcatcatccaacg

SEQ ID NO: 11880 - DNA, 25 bp, Homo sapiens
atccttgctgtgccttccatcttct

SEQ ID NO: 11881 - DNA, 25 bp, Homo sapiens
tctatcagcagccaagtgtcatcgg

SEQ ID NO: 11882 - DNA, 24 bp, Homo sapiens
aggctgatcttgaactcctgacct

SEQ ID NO: 11883 - DNA, 24 bp, Homo sapiens
gtgatctgcccacctcagcctccc

SEQ ID NO: 11884 - DNA, 24 bp, Homo sapiens
acgccgacaagagttgaagtattg

SEQ ID NO: 11885 - DNA, 24 bp, Homo sapiens
gacgccgacaagagttgaagtatt

SEQ ID NO: 11886 - DNA, 24 bp, Homo sapiens
ggacgccgacaagagttgaagtat

SEQ ID NO: 11887 - DNA, 24 bp, Homo sapiens
caattctcctgcctcatcctcctg

SEQ ID NO: 11888 - DNA, 24 bp, Homo sapiens
ccgcctccctggttcaagtgattt

SEQ ID NO: 11889 - DNA, 24 bp, Homo sapiens
tgagccactgcacctgaccatatt

SEQ ID NO: 11890 - DNA, 23 bp, Homo sapiens
cccatctacacgcctctcaccca

SEQ ID NO: 11891 - DNA, 23 bp, Homo sapiens
ggagttgacaggccacttccagg

SEQ ID NO: 11892 - DNA, 23 bp, Homo sapiens
ttcggttagaggccacagaaacg

SEQ ID NO: 11893 - DNA, 24 bp, Homo sapiens
tggctgtgcaggtcttttggctaa

SEQ ID NO: 11894 - DNA, 24 bp, Homo sapiens
ttggctgtgcaggtcttttggcta

SEQ ID NO: 11895 - DNA, 24 bp, Homo sapiens
gttggctgtgcaggtcttttggct

SEQ ID NO: 11896 - DNA, 24 bp, Homo sapiens
tggaatgacagtgcaatacagaat

SEQ ID NO: 11897 - DNA, 24 bp, Homo sapiens
ttggaatgacagtgcaatacagaa

SEQ ID NO: 11898 - DNA, 24 bp, Homo sapiens
tttggaatgacagtgcaatacaga

SEQ ID NO: 11899 - DNA, 24 bp, Homo sapiens
ccagtgcctgagtatgagattgtt

SEQ ID NO: 11900 - DNA, 24 bp, Homo sapiens
accagtgcctgagtatgagattgt

SEQ ID NO: 11901 - DNA, 24 bp, Homo sapiens
aaccagtgcctgagtatgagattg

SEQ ID NO: 11902 - DNA, 24 bp, Homo sapiens
tgccgaggatcttgtgattctgga

SEQ ID NO: 11903 - DNA, 24 bp, Homo sapiens
agtccatcctgcttgtccgacaga

SEQ ID NO: 11904 - DNA, 24 bp, Homo sapiens
cgcagattgagaatacacccatcc

SEQ ID NO: 11905 - DNA, 24 bp, Homo sapiens
cctggaactggaatggctcatcaa

SEQ ID NO: 11906 - DNA, 24 bp, Homo sapiens
ccagacagtgtagtcggcacagat

SEQ ID NO: 11907 - DNA, 24 bp, Homo sapiens
tggaggcattgaaacagaagcagt

SEQ ID NO: 11908 - DNA, 24 bp, Homo sapiens
cgtgccaattatcttgcctctcca

SEQ ID NO: 11909 - DNA, 24 bp, Homo sapiens
acagcacccttatcagacgcagtt

SEQ ID NO: 11910 - DNA, 24 bp, Homo sapiens
tggctatggatgttcaacttgtgt

SEQ ID NO: 11911 - DNA, 24 bp, Homo sapiens
accagtgcctgaacctgaaacagt

SEQ ID NO: 11912 - DNA, 24 bp, Homo sapiens
cgcagattgagaatacacccatcc

SEQ ID NO: 11913 - DNA, 24 bp, Homo sapiens
tgccgaggatcttgtgattctgga

SEQ ID NO: 11914 - DNA, 24 bp, Homo sapiens
ccagactacctgccgaggatcttg

SEQ ID NO: 11915 - DNA, 24 bp, Homo sapiens
cgcagattgagaatacacccatcc

SEQ ID NO: 11916 - DNA, 24 bp, Homo sapiens
gcagaaagcaggaaagctctctcc

SEQ ID NO: 11917 - DNA, 24 bp, Homo sapiens
atgcttggtctgccagtttctctt

SEQ ID NO: 11918 - DNA, 24 bp, Homo sapiens
cagaggtggttggatgtgagttaa

SEQ ID NO: 11919 - DNA, 24 bp, Homo sapiens
tcaggcaagtaggagtggctggaa

SEQ ID NO: 11920 - DNA, 24 bp, Homo sapiens
cagaggtggttggatgtgagttaa

SEQ ID NO: 11921 - DNA, 24 bp, Homo sapiens
tggaggcattgaaacagaagcagt

SEQ ID NO: 11922 - DNA, 24 bp, Homo sapiens
ccagacagtgtagtcggcacagat

SEQ ID NO: 11923 - DNA, 24 bp, Homo sapiens
tcaggcaagtaggagtggctggaa

SEQ ID NO: 11924 - DNA, 24 bp, Homo sapiens
cagaggtggttggatgtgagttaa

SEQ ID NO: 11925 - DNA, 24 bp, Homo sapiens
tggaggcattgaaacagaagcagt

SEQ ID NO: 11926 - DNA, 24 bp, Homo sapiens
ctgttgaagctggtctgcgtgtta

SEQ ID NO: 11927 - DNA, 24 bp, Homo sapiens
tccaggcagtgggatggttacaca

SEQ ID NO: 11928 - DNA, 24 bp, Homo sapiens
tggctatggatgttcaacttgtgt

SEQ ID NO: 11929 - DNA, 24 bp, Homo sapiens
cccatccacagctacaacagatga

SEQ ID NO: 11930 - DNA, 24 bp, Homo sapiens
ccccatccacagctacaacagatg

SEQ ID NO: 11931 - DNA, 24 bp, Homo sapiens
tccccatccacagctacaacagat

SEQ ID NO: 11932 - DNA, 24 bp, Homo sapiens
acatcatgaagctcttggagcagt

SEQ ID NO: 11933 - DNA, 24 bp, Homo sapiens
gacatcatgaagctcttggagcag

SEQ ID NO: 11934 - DNA, 24 bp, Homo sapiens
ggacatcatgaagctcttggagca

SEQ ID NO: 11935 - DNA, 24 bp, Homo sapiens
gccctgcccaggccgcctggttgc

SEQ ID NO: 11936 - DNA, 24 bp, Homo sapiens
cgccctgcccaggccgcctggttg

SEQ ID NO: 11937 - DNA, 24 bp, Homo sapiens
ccgccctgcccaggccgcctggtt

SEQ ID NO: 11938 - DNA, 23 bp, Homo sapiens
cagttctcctgcctcagcctccg

SEQ ID NO: 11939 - DNA, 24 bp, Homo sapiens
gctcagtgaaacctttgcctccca

SEQ ID NO: 11940 - DNA, 23 bp, Homo sapiens
ctgggactacaggcacccacgac

SEQ ID NO: 11941 - DNA, 24 bp, Homo sapiens
cgctggagcagcaggacgggatgg

SEQ ID NO: 11942 - DNA, 24 bp, Homo sapiens
acgctggagcagcaggacgggatg

SEQ ID NO: 11943 - DNA, 24 bp, Homo sapiens
cacgctggagcagcaggacgggat

SEQ ID NO: 11944 - DNA, 24 bp, Homo sapiens
ccgcctgcccggactacccatcgg

SEQ ID NO: 11945 - DNA, 24 bp, Homo sapiens
gccgcctgcccggactacccatcg

SEQ ID NO: 11946 - DNA, 24 bp, Homo sapiens
cgccgcctgcccggactacccatc

SEQ ID NO: 11947 - DNA, 24 bp, Homo sapiens
tcagtgtgaggacaacagaggacc

SEQ ID NO: 11948 - DNA, 24 bp, Homo sapiens
tccaagtgtttccagtgtgatgag

SEQ ID NO: 11949 - DNA, 24 bp, Homo sapiens
cgaggagtttgtgtttgtgggaaa

SEQ ID NO: 11950 - DNA, 24 bp, Homo sapiens
aatcaacccaggcctggtgactcg

SEQ ID NO: 11951 - DNA, 24 bp, Homo sapiens
caatcaacccaggcctggtgactc

SEQ ID NO: 11952 - DNA, 24 bp, Homo sapiens
tcaatcaacccaggcctggtgact

SEQ ID NO: 11953 - DNA, 24 bp, Homo sapiens
gctgagatacggtgagcagtacaa

SEQ ID NO: 11954 - DNA, 24 bp, Homo sapiens
ggctgagatacggtgagcagtaca

SEQ ID NO: 11955 - DNA, 24 bp, Homo sapiens
gggctgagatacggtgagcagtac

SEQ ID NO: 11956 - DNA, 24 bp, Homo sapiens
gtggtcatttggtgtgctgatgtg

SEQ ID NO: 11957 - DNA, 24 bp, Homo sapiens
tgtggtcatttggtgtgctgatgt

SEQ ID NO: 11958 - DNA, 24 bp, Homo sapiens
gtgtggtcatttggtgtgctgatg

SEQ ID NO: 11959 - DNA, 24 bp, Homo sapiens
atccagtttgttttgggaggcaga

SEQ ID NO: 11960 - DNA, 24 bp, Homo sapiens
cagttacagcagggctgagatacg

SEQ ID NO: 11961 - DNA, 24 bp, Homo sapiens
atgatcctcaggaactcgcactgc

SEQ ID NO: 11962 - DNA, 24 bp, Homo sapiens
ctgcctgctggacagttctgagat

SEQ ID NO: 11963 - DNA, 24 bp, Homo sapiens
caggacaggaatgggcatgaagga

SEQ ID NO: 11964 - DNA, 24 bp, Homo sapiens
ggctgcctgtcagattatctacgc

SEQ ID NO: 11965 - DNA, 24 bp, Homo sapiens
ctgggcatgtgtctggatgtgtgt

SEQ ID NO: 11966 - DNA, 24 bp, Homo sapiens
catctgcctggtgtttgagttcat

SEQ ID NO: 11967 - DNA, 24 bp, Homo sapiens
ttcagccctcagtggaccctgatc

SEQ ID NO: 11968 - DNA, 24 bp, Homo sapiens
tttcagccctcagtggaccctgat

SEQ ID NO: 11969 - DNA, 24 bp, Homo sapiens
gtttcagccctcagtggaccctga

SEQ ID NO: 11970 - DNA, 24 bp, Homo sapiens
actccctggtctctgtgcctgaag

SEQ ID NO: 11971 - DNA, 24 bp, Homo sapiens
ctctgcgtggaggtgacagccttg

SEQ ID NO: 11972 - DNA, 24 bp, Homo sapiens
actcttatgttcggctcagacacc

SEQ ID NO: 11973 - DNA, 24 bp, Homo sapiens
cgaagtaggttgcggaatgcccaa

SEQ ID NO: 11974 - DNA, 24 bp, Homo sapiens
actccctggtctctgtgcctgaag

SEQ ID NO: 11975 - DNA, 24 bp, Homo sapiens
ctctgcgtggaggtgacagccttg

SEQ ID NO: 11976 - DNA, 24 bp, Homo sapiens
actccctggtctctgtgcctgaag

SEQ ID NO: 11977 - DNA, 24 bp, Homo sapiens
tctcgaagtaggttgcggaatgcc

SEQ ID NO: 11978 - DNA, 24 bp, Homo sapiens
gcattacttggcagcagaggtgga

SEQ ID NO: 11979 - DNA, 24 bp, Homo sapiens
agctactacaggtgccccgcccca

SEQ ID NO: 11980 - DNA, 24 bp, Homo sapiens
cagctactacaggtgccccgcccc

SEQ ID NO: 11981 - DNA, 24 bp, Homo sapiens
tcagctactacaggtgccccgccc

SEQ ID NO: 11982 - DNA, 24 bp, Homo sapiens
cgacgtggagaatatcatggtgga

SEQ ID NO: 11983 - DNA, 24 bp, Homo sapiens
gcgacgtggagaatatcatggtgg

SEQ ID NO: 11984 - DNA, 24 bp, Homo sapiens
cgcgacgtggagaatatcatggtg

SEQ ID NO: 11985 - DNA, 24 bp, Homo sapiens
tatgcctacagatatcatggtgga

SEQ ID NO: 11986 - DNA, 24 bp, Homo sapiens
ttatgcctacagatatcatggtgg

SEQ ID NO: 11987 - DNA, 24 bp, Homo sapiens
tttatgcctacagatatcatggtg

SEQ ID NO: 11988 - DNA, 24 bp, Homo sapiens
cgctgattgagaaagagagattct

SEQ ID NO: 11989 - DNA, 24 bp, Homo sapiens
acgctgattgagaaagagagattc

SEQ ID NO: 11990 - DNA, 24 bp, Homo sapiens
gacgctgattgagaaagagagatt

SEQ ID NO: 11991 - DNA, 24 bp, Homo sapiens
tgaagagcagaatccagatattgt

SEQ ID NO: 11992 - DNA, 24 bp, Homo sapiens
ttgaagagcagaatccagatattg

SEQ ID NO: 11993 - DNA, 24 bp, Homo sapiens
cttgaagagcagaatccagatatt

SEQ ID NO: 11994 - DNA, 24 bp, Homo sapiens
acttgggagagggccactttggga

SEQ ID NO: 11995 - DNA, 24 bp, Homo sapiens
gacttgggagagggccactttggg

SEQ ID NO: 11996 - DNA, 24 bp, Homo sapiens
tgacttgggagagggccactttgg

SEQ ID NO: 11997 - DNA, 24 bp, Homo sapiens
tgtttgctcagggacagtatgatt

SEQ ID NO: 11998 - DNA, 24 bp, Homo sapiens
ctgtttgctcagggacagtatgat

SEQ ID NO: 11999 - DNA, 24 bp, Homo sapiens
tctgtttgctcagggacagtatga

SEQ ID NO: 12000 - DNA, 24 bp, Homo sapiens
gctccaagaagactgaggtgaacc

SEQ ID NO: 12001 - DNA, 24 bp, Homo sapiens
gcagtggagagtacacagcagagg

SEQ ID NO: 12002 - DNA, 24 bp, Homo sapiens
tgccgtatctctcctctttgtcac

SEQ ID NO: 12003 - DNA, 24 bp, Homo sapiens
attactgccttcctccgccatcaa

SEQ ID NO: 12004 - DNA, 24 bp, Homo sapiens
agcagcctggaagaatatcgttgt

SEQ ID NO: 12005 - DNA, 24 bp, Homo sapiens
gcctgatgctgtctgagtatctga

SEQ ID NO: 12006 - DNA, 24 bp, Homo sapiens
gagcagtcagtgtggcgtcattct

SEQ ID NO: 12007 - DNA, 24 bp, Homo sapiens
gctccaaatcgcaccatcaccgtt

SEQ ID NO: 12008 - DNA, 24 bp, Homo sapiens
gctccaagaagactgaggtgaacc

SEQ ID NO: 12009 - DNA, 24 bp, Homo sapiens
gagccacctcaagaagcagatcct

SEQ ID NO: 12010 - DNA, 24 bp, Homo sapiens
tgcggcaagaaggaagcgaggagg

SEQ ID NO: 12011 - DNA, 24 bp, Homo sapiens
ccatcattacctctgcaccgacgt

SEQ ID NO: 12012 - DNA, 24 bp, Homo sapiens
tggattacaaggatgacgaaggaa

SEQ ID NO: 12013 - DNA, 24 bp, Homo sapiens
cttgggagaggcacgagaacacac

SEQ ID NO: 12014 - DNA, 24 bp, Homo sapiens
atctccaacctgctggtggctact

SEQ ID NO: 12015 - DNA, 24 bp, Homo sapiens
tggaatttctgccttcgggaagcc

SEQ ID NO: 12016 - DNA, 24 bp, Homo sapiens
ggatggactatttgggttctcggc

SEQ ID NO: 12017 - DNA, 24 bp, Homo sapiens
aggagtattacaccgtcaaggatg

SEQ ID NO: 12018 - DNA, 24 bp, Homo sapiens
tcatggaatttctgccttcgggaa

SEQ ID NO: 12019 - DNA, 24 bp, Homo sapiens
aacctcaaacagcagctaaaatat

SEQ ID NO: 12020 - DNA, 24 bp, Homo sapiens
aggaatatcttccaaagaataaga

SEQ ID NO: 12021 - DNA, 24 bp, Homo sapiens
cgtgcccacctaactgtccagatg

SEQ ID NO: 12022 - DNA, 24 bp, Homo sapiens
ttccaaccatccaatcggacaagc

SEQ ID NO: 12023 - DNA, 24 bp, Homo sapiens
cttattgaaggatttgaagcactt

SEQ ID NO: 12024 - DNA, 24 bp, Homo sapiens
gccagatgacagtcacaagacttg

SEQ ID NO: 12025 - DNA, 24 bp, Homo sapiens
ttaaaagaaggaaaacgcctgccg

SEQ ID NO: 12026 - DNA, 24 bp, Homo sapiens
ttccaaccatccaatcggacaagc

SEQ ID NO: 12027 - DNA, 24 bp, Homo sapiens
cttattgaaggatttgaagcactt

SEQ ID NO: 12028 - DNA, 24 bp, Homo sapiens
gcatgaataacatttaaattccac

SEQ ID NO: 12029 - DNA, 24 bp, Homo sapiens
tggagacgagaatattctggttca

SEQ ID NO: 12030 - DNA, 24 bp, Homo sapiens
gtggagacgagaatattctggttc

SEQ ID NO: 12031 - DNA, 24 bp, Homo sapiens
tgtggagacgagaatattctggtt

SEQ ID NO: 12032 - DNA, 24 bp, Homo sapiens
tggagagctgcccaggtttcccag

SEQ ID NO: 12033 - DNA, 24 bp, Homo sapiens
aaaggagaagcacagcgatcaccg

SEQ ID NO: 12034 - DNA, 24 bp, Homo sapiens
gtcaacacgggagaaggaacctgt

SEQ ID NO: 12035 - DNA, 24 bp, Homo sapiens
gcttgctgccacccatcaccaccc

SEQ ID NO: 12036 - DNA, 24 bp, Homo sapiens
aaaggagaagcacagcgatcaccg

SEQ ID NO: 12037 - DNA, 24 bp, Homo sapiens
aatggttccagcaggtcaacacgg

SEQ ID NO: 12038 - DNA, 24 bp, Homo sapiens
gccaccaacaatgcttcatcttca

SEQ ID NO: 12039 - DNA, 24 bp, Homo sapiens
aggccatcaaggtagtccccatac

SEQ ID NO: 12040 - DNA, 24 bp, Homo sapiens
aaggccatcaaggtagtccccata

SEQ ID NO: 12041 - DNA, 24 bp, Homo sapiens
gaaggccatcaaggtagtccccat

SEQ ID NO: 12042 - DNA, 24 bp, Homo sapiens
aaaagaaatatgcaccatgactcc

SEQ ID NO: 12043 - DNA, 24 bp, Homo sapiens
gaaaagaaatatgcaccatgactc

SEQ ID NO: 12044 - DNA, 24 bp, Homo sapiens
agaaaagaaatatgcaccatgact

SEQ ID NO: 12045 - DNA, 24 bp, Homo sapiens
cagcagcagccagttcagccttct

SEQ ID NO: 12046 - DNA, 24 bp, Homo sapiens
ccagtgtctctgtgaagcctccag

SEQ ID NO: 12047 - DNA, 24 bp, Homo sapiens
ccaggtcagcctccagaacatcat

SEQ ID NO: 12048 - DNA, 24 bp, Homo sapiens
tggaaagcatacagttggaccgag

SEQ ID NO: 12049 - DNA, 24 bp, Homo sapiens
tgccagagcccaacacccacaatg

SEQ ID NO: 12050 - DNA, 24 bp, Homo sapiens
acctgcggagatgagatgttgtca

SEQ ID NO: 12051 - DNA, 24 bp, Homo sapiens
cagcagcagccagttcagccttct

SEQ ID NO: 12052 - DNA, 24 bp, Homo sapiens
ctcaccatagcagcagagcctagt

SEQ ID NO: 12053 - DNA, 24 bp, Homo sapiens
ccaggtcagcctccagaacatcat

SEQ ID NO: 12054 - DNA, 24 bp, Homo sapiens
ctctgtaccagttgctgtggttgg

SEQ ID NO: 12055 - DNA, 24 bp, Homo sapiens
cctctgtaccagttgctgtggttg

SEQ ID NO: 12056 - DNA, 24 bp, Homo sapiens
tcctctgtaccagttgctgtggtt

SEQ ID NO: 12057 - DNA, 25 bp, Homo sapiens
acttcgcatccgtccctttgtatca

SEQ ID NO: 12058 - DNA, 24 bp, Homo sapiens
cccgccgtggggcctccccagccc

SEQ ID NO: 12059 - DNA, 24 bp, Homo sapiens
gcccgccgtggggcctccccagcc

SEQ ID NO: 12060 - DNA, 24 bp, Homo sapiens
ggcccgccgtggggcctccccagc

SEQ ID NO: 12061 - DNA, 24 bp, Homo sapiens
catccctgagggagcctttgatga

SEQ ID NO: 12062 - DNA, 24 bp, Homo sapiens
gcatccctgagggagcctttgatg

SEQ ID NO: 12063 - DNA, 24 bp, Homo sapiens
ggcatccctgagggagcctttgat

SEQ ID NO: 12064 - DNA, 24 bp, Homo sapiens
tcccaccataggcttcaacgtgga

SEQ ID NO: 12065 - DNA, 24 bp, Homo sapiens
ttcccaccataggcttcaacgtgg

SEQ ID NO: 12066 - DNA, 24 bp, Homo sapiens
attcccaccataggcttcaacgtg

SEQ ID NO: 12067 - DNA, 24 bp, Homo sapiens
gaacacacaaggcctgatcttcgt

SEQ ID NO: 12068 - DNA, 24 bp, Homo sapiens
agaacacacaaggcctgatcttcg

SEQ ID NO: 12069 - DNA, 24 bp, Homo sapiens
cagaacacacaaggcctgatcttc

SEQ ID NO: 12070 - DNA, 24 bp, Homo sapiens
ccaacaagcaggacctccccaacg

SEQ ID NO: 12071 - DNA, 24 bp, Homo sapiens
gccaacaagcaggacctccccaac

SEQ ID NO: 12072 - DNA, 24 bp, Homo sapiens
cgccaacaagcaggacctccccaa

SEQ ID NO: 12073 - DNA, 25 bp, Homo sapiens
ggaacatcttcgccaacctcttcaa

SEQ ID NO: 12074 - DNA, 24 bp, Homo sapiens
tgaccaccattcccaccataggct

SEQ ID NO: 12075 - DNA, 25 bp, Homo sapiens
aaccgtggagtacaagaacatcagc

SEQ ID NO: 12076 - DNA, 25 bp, Homo sapiens
acagcaatgacagagagcgtgtgaa

SEQ ID NO: 12077 - DNA, 23 bp, Homo sapiens
agctccgggatgctgtcctcctg

SEQ ID NO: 12078 - DNA, 23 bp, Homo sapiens
gaggagctcatgaggatgctggc

SEQ ID NO: 12079 - DNA, 25 bp, Homo sapiens
aaccgtggagtacaagaacatcagc

SEQ ID NO: 12080 - DNA, 24 bp, Homo sapiens
tgaccaccattcccaccataggct

SEQ ID NO: 12081 - DNA, 24 bp, Homo sapiens
ggaagaccacgatcctctacaagc

SEQ ID NO: 12082 - DNA, 23 bp, Homo sapiens
gcactcactacgccacaggaact

SEQ ID NO: 12083 - DNA, 25 bp, Homo sapiens
ggctctatgaaggactggactggct

SEQ ID NO: 12084 - DNA, 24 bp, Homo sapiens
ctccctctcactcctcttgccctc

SEQ ID NO: 12085 - DNA, 25 bp, Homo sapiens
acagcaatgacagagagcgtgtgaa

SEQ ID NO: 12086 - DNA, 23 bp, Homo sapiens
gctcatgaggatgctggccgagg

SEQ ID NO: 12087 - DNA, 25 bp, Homo sapiens
cgccactacttccagaacacacaag

SEQ ID NO: 12088 - DNA, 25 bp, Homo sapiens
tcttcgtggtggacagcaatgacag

SEQ ID NO: 12089 - DNA, 23 bp, Homo sapiens
gatgctgtcctcctggtgttcgc

SEQ ID NO: 12090 - DNA, 24 bp, Homo sapiens
cggccgagatcacagacaagctgg

SEQ ID NO: 12091 - DNA, 24 bp, Homo sapiens
gcggccgagatcacagacaagctg

SEQ ID NO: 12092 - DNA, 24 bp, Homo sapiens
tgcggccgagatcacagacaagct

SEQ ID NO: 12093 - DNA, 23 bp, Homo sapiens
gatgctgtcctcctggtgttcgc

SEQ ID NO: 12094 - DNA, 25 bp, Homo sapiens
tcttcgtggtggacagcaatgacag

SEQ ID NO: 12095 - DNA, 25 bp, Homo sapiens
aaccgtggagtacaagaacatcagc

SEQ ID NO: 12096 - DNA, 25 bp, Homo sapiens
tgtttccaatgaggcagtttctggt

SEQ ID NO: 12097 - DNA, 23 bp, Homo sapiens
gtaaatgtggcagacgcagcctg

SEQ ID NO: 12098 - DNA, 25 bp, Homo sapiens
ggctctatgaaggactggactggct

SEQ ID NO: 12099 - DNA, 23 bp, Homo sapiens
gcactcactacgccacaggaact

SEQ ID NO: 12100 - DNA, 23 bp, Homo sapiens
gatgctgtcctcctggtgttcgc

SEQ ID NO: 12101 - DNA, 24 bp, Homo sapiens
ggaactggtacattcaggccacct

SEQ ID NO: 12102 - DNA, 24 bp, Homo sapiens
aggaactggtacattcaggccacc

SEQ ID NO: 12103 - DNA, 24 bp, Homo sapiens
caggaactggtacattcaggccac

SEQ ID NO: 12104 - DNA, 24 bp, Homo sapiens
ggcagacgcagcctgcggccaggc

SEQ ID NO: 12105 - DNA, 24 bp, Homo sapiens
tggcagacgcagcctgcggccagg

SEQ ID NO: 12106 - DNA, 24 bp, Homo sapiens
gtggcagacgcagcctgcggccag

SEQ ID NO: 12107 - DNA, 25 bp, Homo sapiens
tcttcgtggtggacagcaatgacag

SEQ ID NO: 12108 - DNA, 23 bp, Homo sapiens
gatgctgtcctcctggtgttcgc

SEQ ID NO: 12109 - DNA, 23 bp, Homo sapiens
gcactcactacgccacaggaact

SEQ ID NO: 12110 - DNA, 23 bp, Homo sapiens
cttccacctgtccacaagcatgg

SEQ ID NO: 12111 - DNA, 24 bp, Homo sapiens
ggaagaccacgatcctctacaagc

SEQ ID NO: 12112 - DNA, 25 bp, Homo sapiens
atcgtgaccaccattcccaccatag

SEQ ID NO: 12113 - DNA, 25 bp, Homo sapiens
ggaacatcttcgccaacctcttcaa

SEQ ID NO: 12114 - DNA, 24 bp, Homo sapiens
ggaagaccacgatcctctacaagc

SEQ ID NO: 12115 - DNA, 24 bp, Homo sapiens
tgaccaccattcccaccataggct

SEQ ID NO: 12116 - DNA, 23 bp, Homo sapiens
gctcgtggtgtgagtgccagaag

SEQ ID NO: 12117 - DNA, 25 bp, Homo sapiens
ggctctatgaaggactggactggct

SEQ ID NO: 12118 - DNA, 23 bp, Homo sapiens
gcactcactacgccacaggaact

SEQ ID NO: 12119 - DNA, 24 bp, Homo sapiens
aagggactacacctcttcgcagtg

SEQ ID NO: 12120 - DNA, 25 bp, Homo sapiens
tgtttgagcctactcgtttgattgc

SEQ ID NO: 12121 - DNA, 23 bp, Homo sapiens
cctcatgggaccagtgaaacagc

SEQ ID NO: 12122 - DNA, 24 bp, Homo sapiens
gcattcattagacgaggctgaggc

SEQ ID NO: 12123 - DNA, 24 bp, Homo sapiens
gggagtctgaggtgggaggattga

SEQ ID NO: 12124 - DNA, 24 bp, Homo sapiens
ctcacgcctgtaatcccagcactt

SEQ ID NO: 12125 - DNA, 24 bp, Homo sapiens
tgaggcaggagaatggcgtgaacc

SEQ ID NO: 12126 - DNA, 24 bp, Homo sapiens
ctcacgcctgtaatcccagcactt

SEQ ID NO: 12127 - DNA, 24 bp, Homo sapiens
ctgggcgacagagcgagactccgt

SEQ ID NO: 12128 - DNA, 25 bp, Homo sapiens
tcctgagaatgagaaccctgccttt

SEQ ID NO: 12129 - DNA, 23 bp, Homo sapiens
gcctgctcttctgctgctccttt

SEQ ID NO: 12130 - DNA, 23 bp, Homo sapiens
cgctctccttctcgctgcccgtg

SEQ ID NO: 12131 - DNA, 25 bp, Homo sapiens
gtggactgtatgtgattgacctgac

SEQ ID NO: 12132 - DNA, 25 bp, Homo sapiens
acctattgccactcttgacttaact

SEQ ID NO: 12133 - DNA, 25 bp, Homo sapiens
aggagccaaccagtcttcagacatg

SEQ ID NO: 12134 - DNA, 25 bp, Homo sapiens
gtggactgtatgtgattgacctgac

SEQ ID NO: 12135 - DNA, 23 bp, Homo sapiens
cctctctggcaaagcggtgatgg

SEQ ID NO: 12136 - DNA, 25 bp, Homo sapiens
tcagcctacagcacggagaatcatt

SEQ ID NO: 12137 - DNA, 24 bp, Homo sapiens
gatgctggcttgaggctgtagtgg

SEQ ID NO: 12138 - DNA, 23 bp, Homo sapiens
tctgtgcctgctgttccctgctg

SEQ ID NO: 12139 - DNA, 23 bp, Homo sapiens
ggcgtccagctgcatttcccact

SEQ ID NO: 12140 - DNA, 24 bp, Homo sapiens
tgagaagccagcccgggcagtgag

SEQ ID NO: 12141 - DNA, 24 bp, Homo sapiens
gtgagaagccagcccgggcagtga

SEQ ID NO: 12142 - DNA, 24 bp, Homo sapiens
tgtgagaagccagcccgggcagtg

SEQ ID NO: 12143 - DNA, 25 bp, Homo sapiens
tctgcctggaggtcttcaaggagtc

SEQ ID NO: 12144 - DNA, 23 bp, Homo sapiens
gctgcctggtttccctgtcctac

SEQ ID NO: 12145 - DNA, 23 bp, Homo sapiens
catgtgctggcaggtggtggacg

SEQ ID NO: 12146 - DNA, 24 bp, Homo sapiens
gaggtcgcacggtggtggacggca

SEQ ID NO: 12147 - DNA, 24 bp, Homo sapiens
agaggtcgcacggtggtggacggc

SEQ ID NO: 12148 - DNA, 24 bp, Homo sapiens
cagaggtcgcacggtggtggacgg

SEQ ID NO: 12149 - DNA, 23 bp, Homo sapiens
gctgaagcaggagcagaagaagg

SEQ ID NO: 12150 - DNA, 23 bp, Homo sapiens
agctcatcgccaaactggtgaaa

SEQ ID NO: 12151 - DNA, 24 bp, Homo sapiens
cctggctccagcatccccagcacc

SEQ ID NO: 12152 - DNA, 24 bp, Homo sapiens
tcctggctccagcatccccagcac

SEQ ID NO: 12153 - DNA, 24 bp, Homo sapiens
ctcctggctccagcatccccagca

SEQ ID NO: 12154 - DNA, 24 bp, Homo sapiens
acatcatcaccatcatcatggtgc

SEQ ID NO: 12155 - DNA, 24 bp, Homo sapiens
gacatcatcaccatcatcatggtg

SEQ ID NO: 12156 - DNA, 24 bp, Homo sapiens
ggacatcatcaccatcatcatggt

SEQ ID NO: 12157 - DNA, 24 bp, Homo sapiens
agcctgccgaggccccaccttcgc

SEQ ID NO: 12158 - DNA, 24 bp, Homo sapiens
gagcctgccgaggccccaccttcg

SEQ ID NO: 12159 - DNA, 24 bp, Homo sapiens
ggagcctgccgaggccccaccttc

SEQ ID NO: 12160 - DNA, 24 bp, Homo sapiens
tatggactttgtgcttggcgcccc

SEQ ID NO: 12161 - DNA, 24 bp, Homo sapiens
ttatggactttgtgcttggcgccc

SEQ ID NO: 12162 - DNA, 24 bp, Homo sapiens
tttatggactttgtgcttggcgcc

SEQ ID NO: 12163 - DNA, 24 bp, Homo sapiens
tccgagaaaaggttttggggaagg

SEQ ID NO: 12164 - DNA, 24 bp, Homo sapiens
atccgagaaaaggttttggggaag

SEQ ID NO: 12165 - DNA, 24 bp, Homo sapiens
aatccgagaaaaggttttggggaa

SEQ ID NO: 12166 - DNA, 23 bp, Homo sapiens
ccgcactccttggcttcctttcc

SEQ ID NO: 12167 - DNA, 23 bp, Homo sapiens
gtaacctgtcttgggagtgtgag

SEQ ID NO: 12168 - DNA, 23 bp, Homo sapiens
ggcaaggctgctgaagatcgctt

SEQ ID NO: 12169 - DNA, 24 bp, Homo sapiens
gaacgtacacccggatgtgatgct

SEQ ID NO: 12170 - DNA, 24 bp, Homo sapiens
agaacgtacacccggatgtgatgc

SEQ ID NO: 12171 - DNA, 24 bp, Homo sapiens
gagaacgtacacccggatgtgatg

SEQ ID NO: 12172 - DNA, 24 bp, Homo sapiens
ctctttttgcaatcacaatcgaag

SEQ ID NO: 12173 - DNA, 24 bp, Homo sapiens
gctctttttgcaatcacaatcgaa

SEQ ID NO: 12174 - DNA, 24 bp, Homo sapiens
tgctctttttgcaatcacaatcga

SEQ ID NO: 12175 - DNA, 24 bp, Homo sapiens
taactaaacaggacgaaaatgatg

SEQ ID NO: 12176 - DNA, 24 bp, Homo sapiens
ctaactaaacaggacgaaaatgat

SEQ ID NO: 12177 - DNA, 24 bp, Homo sapiens
actaactaaacaggacgaaaatga

SEQ ID NO: 12178 - DNA, 24 bp, Homo sapiens
ccaggaaacagtcaggttgccaga

SEQ ID NO: 12179 - DNA, 24 bp, Homo sapiens
gtgtgtggctggtattgcttgtgc

SEQ ID NO: 12180 - DNA, 24 bp, Homo sapiens
gccaagatatagacccagagcagc

SEQ ID NO: 12181 - DNA, 24 bp, Homo sapiens
tcagaggcagcagaacaaggacgg

SEQ ID NO: 12182 - DNA, 24 bp, Homo sapiens
tctggtccaatgtctgtgatgagg

SEQ ID NO: 12183 - DNA, 24 bp, Homo sapiens
ggagcactacagtatctggttcca

SEQ ID NO: 12184 - DNA, 24 bp, Homo sapiens
gccacctgctgtgaagatgacatt

SEQ ID NO: 12185 - DNA, 24 bp, Homo sapiens
acatcaagaacccagattggcggt

SEQ ID NO: 12186 - DNA, 24 bp, Homo sapiens
tggaaggaccagagcccagtcagc

SEQ ID NO: 12187 - DNA, 24 bp, Homo sapiens
tctggtccaatgtctgtgatgagg

SEQ ID NO: 12188 - DNA, 24 bp, Homo sapiens
gcttcagaggcagcagaacaagga

SEQ ID NO: 12189 - DNA, 24 bp, Homo sapiens
ggagcactacagtatctggttcca

SEQ ID NO: 12190 - DNA, 24 bp, Homo sapiens
tctggtccaatgtctgtgatgagg

SEQ ID NO: 12191 - DNA, 24 bp, Homo sapiens
tgatgaggtggctttacaagggat

SEQ ID NO: 12192 - DNA, 24 bp, Homo sapiens
acgagggtacgagtggctgcttta

SEQ ID NO: 12193 - DNA, 24 bp, Homo sapiens
gctacgaatgcactcctgaactca

SEQ ID NO: 12194 - DNA, 24 bp, Homo sapiens
atccaatgagattctgactgccat

SEQ ID NO: 12195 - DNA, 24 bp, Homo sapiens
ggagcactacagtatctggttcca

SEQ ID NO: 12196 - DNA, 24 bp, Homo sapiens
cccctgagcacaccagcaagtttt

SEQ ID NO: 12197 - DNA, 24 bp, Homo sapiens
gatgactggaacccctgcaaagca

SEQ ID NO: 12198 - DNA, 24 bp, Homo sapiens
catatccagagcacatccgataga

SEQ ID NO: 12199 - DNA, 24 bp, Homo sapiens
ttgtatcttggaaggaccagagcc

SEQ ID NO: 12200 - DNA, 24 bp, Homo sapiens
acatcaagaacccagattggcggt

SEQ ID NO: 12201 - DNA, 24 bp, Homo sapiens
ggttccaatcctcacacagacact

SEQ ID NO: 12202 - DNA, 24 bp, Homo sapiens
gtgggcttagtgggagacttgtgc

SEQ ID NO: 12203 - DNA, 24 bp, Homo sapiens
tgtgaagccgcagattctgtcagt

SEQ ID NO: 12204 - DNA, 24 bp, Homo sapiens
ttggaagcctatactggaatcgtc

SEQ ID NO: 12205 - DNA, 24 bp, Homo sapiens
tgtgaagccgcagattctgtcagt

SEQ ID NO: 12206 - DNA, 24 bp, Homo sapiens
ttggaagcctatactggaatcgtc

SEQ ID NO: 12207 - DNA, 24 bp, Homo sapiens
tgaccacattgctggagatgagga

SEQ ID NO: 12208 - DNA, 24 bp, Homo sapiens
tgtgaagccgcagattctgtcagt

SEQ ID NO: 12209 - DNA, 24 bp, Homo sapiens
ttgcccttgctattggaggagagt

SEQ ID NO: 12210 - DNA, 24 bp, Homo sapiens
tgtattgaatactcttcagcaggc

SEQ ID NO: 12211 - DNA, 24 bp, Homo sapiens
gaacgtacacccggatgtgatgct

SEQ ID NO: 12212 - DNA, 24 bp, Homo sapiens
agaacgtacacccggatgtgatgc

SEQ ID NO: 12213 - DNA, 24 bp, Homo sapiens
gagaacgtacacccggatgtgatg

SEQ ID NO: 12214 - DNA, 24 bp, Homo sapiens
actgaagggcggagatcgaagact

SEQ ID NO: 12215 - DNA, 24 bp, Homo sapiens
actgaggaaactgaagaaccaagc

SEQ ID NO: 12216 - DNA, 24 bp, Homo sapiens
accattgggatgataacctgagga

SEQ ID NO: 12217 - DNA, 24 bp, Homo sapiens
gaggatgcccagtgagtcccaggc

SEQ ID NO: 12218 - DNA, 24 bp, Homo sapiens
cgaggatgcccagtgagtcccagg

SEQ ID NO: 12219 - DNA, 24 bp, Homo sapiens
gcgaggatgcccagtgagtcccag

SEQ ID NO: 12220 - DNA, 24 bp, Homo sapiens
ctatggcggtggcttcagcagcag

SEQ ID NO: 12221 - DNA, 24 bp, Homo sapiens
gcctgtctgtctcctctcgcttct

SEQ ID NO: 12222 - DNA, 24 bp, Homo sapiens
ctccagccgcatctcctccgtcct

SEQ ID NO: 12223 - DNA, 24 bp, Homo sapiens
ctgcctctaccacagcctcctgcc

SEQ ID NO: 12224 - DNA, 24 bp, Homo sapiens
ctcctctgctggtggtgggctaat

SEQ ID NO: 12225 - DNA, 24 bp, Homo sapiens
gtcagacccggcccatcctcaagg

SEQ ID NO: 12226 - DNA, 24 bp, Homo sapiens
gctatcacacggcacgacttcatc

SEQ ID NO: 12227 - DNA, 23 bp, Homo sapiens
acaactgcctggtgacactgctg

SEQ ID NO: 12228 - DNA, 25 bp, Homo sapiens
atcatcttcggcaccttcaccaacc

SEQ ID NO: 12229 - DNA, 25 bp, Homo sapiens
attgtaacccctccactcccctctg

SEQ ID NO: 12230 - DNA, 24 bp, Homo sapiens
tgaggcaggagaatcgcttgaacc

SEQ ID NO: 12231 - DNA, 24 bp, Homo sapiens
ctgaggcaggagaatcgcttgaac

SEQ ID NO: 12232 - DNA, 24 bp, Homo sapiens
gctgaggcaggagaatcgcttgaa

SEQ ID NO: 12233 - DNA, 24 bp, Homo sapiens
cgaggtgagcagtgagcggcgagc

SEQ ID NO: 12234 - DNA, 24 bp, Homo sapiens
ctagcgaccctctcgccacctgcg

SEQ ID NO: 12235 - DNA, 24 bp, Homo sapiens
gagaacgcgccaccgcggggcccg

SEQ ID NO: 12236 - DNA, 24 bp, Homo sapiens
cgaccaccgcccgggagcagcgcg

SEQ ID NO: 12237 - DNA, 24 bp, Homo sapiens
gcgaccaccgcccgggagcagcgc

SEQ ID NO: 12238 - DNA, 24 bp, Homo sapiens
agcgaccaccgcccgggagcagcg

SEQ ID NO: 12239 - DNA, 24 bp, Homo sapiens
tttgcaactgggtcagaatggtgg

SEQ ID NO: 12240 - DNA, 24 bp, Homo sapiens
ctttgcaactgggtcagaatggtg

SEQ ID NO: 12241 - DNA, 24 bp, Homo sapiens
tctttgcaactgggtcagaatggt

SEQ ID NO: 12242 - DNA, 24 bp, Homo sapiens
tactgcctcacaacagcctccaca

SEQ ID NO: 12243 - DNA, 24 bp, Homo sapiens
ccagtcagcctctacagaccaagc

SEQ ID NO: 12244 - DNA, 24 bp, Homo sapiens
ctcctgcctcccagccttctctcc

SEQ ID NO: 12245 - DNA, 24 bp, Homo sapiens
gctggagtgtagtagtgctatcgc

SEQ ID NO: 12246 - DNA, 24 bp, Homo sapiens
ctgaagcgatcctcccacctcaac

SEQ ID NO: 12247 - DNA, 24 bp, Homo sapiens
cgtggctgagactacaggtgcttg

SEQ ID NO: 12248 - DNA, 24 bp, Homo sapiens
gctggagtgtagtagtgctatcgc

SEQ ID NO: 12249 - DNA, 24 bp, Homo sapiens
cgtggctgagactacaggtgcttg

SEQ ID NO: 12250 - DNA, 24 bp, Homo sapiens
tactgcctcacaacagcctccaca

SEQ ID NO: 12251 - DNA, 24 bp, Homo sapiens
gcctcacagcagattcttcacgcc

SEQ ID NO: 12252 - DNA, 24 bp, Homo sapiens
ctcccgtcagcctctacagtccca

SEQ ID NO: 12253 - DNA, 24 bp, Homo sapiens
ctcctgcctcccagccttctctcc

SEQ ID NO: 12254 - DNA, 24 bp, Homo sapiens
tctacattatgctcctacctcccg

SEQ ID NO: 12255 - DNA, 24 bp, Homo sapiens
ccagtcagcctctacagaccaagc

SEQ ID NO: 12256 - DNA, 24 bp, Homo sapiens
tactgcctcacaacagcctccaca

SEQ ID NO: 12257 - DNA, 24 bp, Homo sapiens
gcttaacacgcccactgattctac

SEQ ID NO: 12258 - DNA, 24 bp, Homo sapiens
ccagtcagcctctacagaccaagc

SEQ ID NO: 12259 - DNA, 24 bp, Homo sapiens
tactgcctcacaacagcctccaca

SEQ ID NO: 12260 - DNA, 24 bp, Homo sapiens
ccagtcagcctctacagaccaagc

SEQ ID NO: 12261 - DNA, 24 bp, Homo sapiens
tactgcctcacaacagcctccaca

SEQ ID NO: 12262 - DNA, 24 bp, Homo sapiens
gctggagtgtagtagtgctatcgc

SEQ ID NO: 12263 - DNA, 24 bp, Homo sapiens
cttcactcctgagcccagcgagac

SEQ ID NO: 12264 - DNA, 24 bp, Homo sapiens
agctgtaacactcaccgcgaagat

SEQ ID NO: 12265 - DNA, 24 bp, Homo sapiens
caactccagacgcgctgccttaag

SEQ ID NO: 12266 - DNA, 24 bp, Homo sapiens
agcgattctcctgcctcagtctcc

SEQ ID NO: 12267 - DNA, 24 bp, Homo sapiens
gatcattgcaaccttcacctccca

SEQ ID NO: 12268 - DNA, 24 bp, Homo sapiens
ggctggagtgcagcagcgcaatct

SEQ ID NO: 12269 - DNA, 24 bp, Homo sapiens
gaggttgcagtgagctgagatcgc

SEQ ID NO: 12270 - DNA, 24 bp, Homo sapiens
cctgggcgacagagcgagactcca

SEQ ID NO: 12271 - DNA, 24 bp, Homo sapiens
gctggagtgtagtagtgctatcgc

SEQ ID NO: 12272 - DNA, 24 bp, Homo sapiens
cgtggctgagactacaggtgcttg

SEQ ID NO: 12273 - DNA, 24 bp, Homo sapiens
gcttaacacgcccactgattctac

SEQ ID NO: 12274 - DNA, 24 bp, Homo sapiens
gcctcacagcagattcttcacgcc

SEQ ID NO: 12275 - DNA, 24 bp, Homo sapiens
tactgcctcacaacagcctccaca

SEQ ID NO: 12276 - DNA, 24 bp, Homo sapiens
ccagtcagcctctacagaccaagc

SEQ ID NO: 12277 - DNA, 24 bp, Homo sapiens
gcttaacacgcccactgattctac

SEQ ID NO: 12278 - DNA, 24 bp, Homo sapiens
ccagtcagcctctacagaccaagc

SEQ ID NO: 12279 - DNA, 24 bp, Homo sapiens
cataccctacgtcacggcagcctc

SEQ ID NO: 12280 - DNA, 24 bp, Homo sapiens
ctcctgcctcccagccttctctcc

SEQ ID NO: 12281 - DNA, 24 bp, Homo sapiens
agctccatcgttacaatggcctct

SEQ ID NO: 12282 - DNA, 24 bp, Homo sapiens
tactgcctcacaacagcctccaca

SEQ ID NO: 12283 - DNA, 24 bp, Homo sapiens
ccagtcagcctctacagaccaagc

SEQ ID NO: 12284 - DNA, 24 bp, Homo sapiens
cgtggctgagactacaggtgcttg

SEQ ID NO: 12285 - DNA, 24 bp, Homo sapiens
cgtggctgagactacaggtgcttg

SEQ ID NO: 12286 - DNA, 24 bp, Homo sapiens
gctggagtgtagtagtgctatcgc

SEQ ID NO: 12287 - DNA, 24 bp, Homo sapiens
ctactgcctcacaacagcctccac

SEQ ID NO: 12288 - DNA, 24 bp, Homo sapiens
ccagtcagcctctacagaccaagc

SEQ ID NO: 12289 - DNA, 24 bp, Homo sapiens
cataccctacgtcacggcagcctc

SEQ ID NO: 12290 - DNA, 24 bp, Homo sapiens
tactgcctcacaacagcctccaca

SEQ ID NO: 12291 - DNA, 23 bp, Homo sapiens
cgatctcggctcactgcaacctc

SEQ ID NO: 12292 - DNA, 24 bp, Homo sapiens
gttcaagcagttctgcctcagcct

SEQ ID NO: 12293 - DNA, 24 bp, Homo sapiens
gcgattctcctgcttcagccttct

SEQ ID NO: 12294 - DNA, 24 bp, Homo sapiens
gatctcagctcactgcaacctctg

SEQ ID NO: 12295 - DNA, 24 bp, Homo sapiens
cgtcgtgatccagaagtccagagc

SEQ ID NO: 12296 - DNA, 25 bp, Homo sapiens
ggatgtgttcaaggcaagaccgaat

SEQ ID NO: 12297 - DNA, 24 bp, Homo sapiens
gggtggaaatagcggctgcttctt

SEQ ID NO: 12298 - DNA, 24 bp, Homo sapiens
gcaatcctaccatgtcagccttcc

SEQ ID NO: 12299 - DNA, 24 bp, Homo sapiens
gttcagtggtcctatcatggctca

SEQ ID NO: 12300 - DNA, 24 bp, Homo sapiens
cgtggctgagactacaggtgcttg

SEQ ID NO: 12301 - DNA, 24 bp, Homo sapiens
ccagtcagcctctacagaccaagc

SEQ ID NO: 12302 - DNA, 24 bp, Homo sapiens
caaggctggagtgtagtagtgcta

SEQ ID NO: 12303 - DNA, 24 bp, Homo sapiens
gatccatccacctcagcctcccaa

SEQ ID NO: 12304 - DNA, 24 bp, Homo sapiens
tgatccatccacctcagcctccca

SEQ ID NO: 12305 - DNA, 24 bp, Homo sapiens
gtgatccatccacctcagcctccc

SEQ ID NO: 12306 - DNA, 24 bp, Homo sapiens
aggagctgaatgcaataagaacag

SEQ ID NO: 12307 - DNA, 24 bp, Homo sapiens
gaggagctgaatgcaataagaaca

SEQ ID NO: 12308 - DNA, 24 bp, Homo sapiens
agaggagctgaatgcaataagaac

SEQ ID NO: 12309 - DNA, 24 bp, Homo sapiens
agtggttacaggatcttcaagaag

SEQ ID NO: 12310 - DNA, 24 bp, Homo sapiens
aagtggttacaggatcttcaagaa

SEQ ID NO: 12311 - DNA, 24 bp, Homo sapiens
gaagtggttacaggatcttcaaga

SEQ ID NO: 12312 - DNA, 24 bp, Homo sapiens
aggaggttaaggttctagagcaca

SEQ ID NO: 12313 - DNA, 24 bp, Homo sapiens
gaggaggttaaggttctagagcac

SEQ ID NO: 12314 - DNA, 24 bp, Homo sapiens
agaggaggttaaggttctagagca

SEQ ID NO: 12315 - DNA, 24 bp, Homo sapiens
tgctaattcaggtcagttatctct

SEQ ID NO: 12316 - DNA, 24 bp, Homo sapiens
atgctaattcaggtcagttatctc

SEQ ID NO: 12317 - DNA, 24 bp, Homo sapiens
aatgctaattcaggtcagttatct

SEQ ID NO: 12318 - DNA, 24 bp, Homo sapiens
gcctaccttgacacatgctctcct

SEQ ID NO: 12319 - DNA, 24 bp, Homo sapiens
actggacttattcaggtggcaact

SEQ ID NO: 12320 - DNA, 24 bp, Homo sapiens
gaggagctgaatgcaataagaaca

SEQ ID NO: 12321 - DNA, 24 bp, Homo sapiens
tctgtagaagagcttctggaggca

SEQ ID NO: 12322 - DNA, 24 bp, Homo sapiens
ttcacttgcctcagcctcccaaag

SEQ ID NO: 12323 - DNA, 24 bp, Homo sapiens
tgttggctaggatggtcttgatct

SEQ ID NO: 12324 - DNA, 24 bp, Homo sapiens
ccaccacacccggccttgagttta

SEQ ID NO: 12325 - DNA, 24 bp, Homo sapiens
tcaagcacctggcaaagtggaacc

SEQ ID NO: 12326 - DNA, 24 bp, Homo sapiens
ggagatgacctggcttccaccact

SEQ ID NO: 12327 - DNA, 23 bp, Homo sapiens
agtcgtcttcggaaaccagcgtg

SEQ ID NO: 12328 - DNA, 23 bp, Homo sapiens
ccagccacacctcggacacacct

SEQ ID NO: 12329 - DNA, 23 bp, Homo sapiens
tgccaccaaggactctgagagcg

SEQ ID NO: 12330 - DNA, 23 bp, Homo sapiens
ccatcaacgccaggaccaccagt

SEQ ID NO: 12331 - DNA, 24 bp, Homo sapiens
gacttaacttcttccagccgacct

SEQ ID NO: 12332 - DNA, 23 bp, Homo sapiens
aatgcttcggtcgcccatctcac

SEQ ID NO: 12333 - DNA, 25 bp, Homo sapiens
ttgtttacttcagcctcttccagca

SEQ ID NO: 12334 - DNA, 25 bp, Homo sapiens
gccctacatcatctgctaccctgaa

SEQ ID NO: 12335 - DNA, 23 bp, Homo sapiens
gagagcccgtgccaagaactagc

SEQ ID NO: 12336 - DNA, 23 bp, Homo sapiens
gtctcgtctcacccactcccagc

SEQ ID NO: 12337 - DNA, 24 bp, Homo sapiens
ccgcccggaaggcctcccgccgca

SEQ ID NO: 12338 - DNA, 24 bp, Homo sapiens
accgcccggaaggcctcccgccgc

SEQ ID NO: 12339 - DNA, 24 bp, Homo sapiens
caccgcccggaaggcctcccgccg

SEQ ID NO: 12340 - DNA, 24 bp, Homo sapiens
cccctcatcagcttcaagttcggg

SEQ ID NO: 12341 - DNA, 24 bp, Homo sapiens
gcccctcatcagcttcaagttcgg

SEQ ID NO: 12342 - DNA, 24 bp, Homo sapiens
agcccctcatcagcttcaagttcg

SEQ ID NO: 12343 - DNA, 24 bp, Homo sapiens
atccacacagaagagccccgcgac

SEQ ID NO: 12344 - DNA, 24 bp, Homo sapiens
ccccaagcccatgcccccacggcc

SEQ ID NO: 12345 - DNA, 24 bp, Homo sapiens
ccctgctcacctttgacctctacc

SEQ ID NO: 12346 - DNA, 24 bp, Homo sapiens
accagtacaatgagctgcacctgc

SEQ ID NO: 12347 - DNA, 24 bp, Homo sapiens
tcatcctcaagaccttcctccggg

SEQ ID NO: 12348 - DNA, 24 bp, Homo sapiens
tcgtcttcctcaccgccaatctgt

SEQ ID NO: 12349 - DNA, 24 bp, Homo sapiens
gtgggtctggactttgtgtgcctg

SEQ ID NO: 12350 - DNA, 24 bp, Homo sapiens
ctcgtcgcttggtgaatcgcctgg

SEQ ID NO: 12351 - DNA, 24 bp, Homo sapiens
ctcgtcgcttggtgaatcgcctgg

SEQ ID NO: 12352 - DNA, 24 bp, Homo sapiens
ctcaccgccaatctgtgcctgctc

SEQ ID NO: 12353 - DNA, 24 bp, Homo sapiens
gtgggtctggactttgtgtgcctg

SEQ ID NO: 12354 - DNA, 24 bp, Homo sapiens
ggctcttgaaggtgagacgagaga

SEQ ID NO: 12355 - DNA, 24 bp, Homo sapiens
gggctcttgaaggtgagacgagag

SEQ ID NO: 12356 - DNA, 24 bp, Homo sapiens
ggggctcttgaaggtgagacgaga

SEQ ID NO: 12357 - DNA, 24 bp, Homo sapiens
caggactgcgggagaaggatgaca

SEQ ID NO: 12358 - DNA, 24 bp, Homo sapiens
tcaggactgcgggagaaggatgac

SEQ ID NO: 12359 - DNA, 24 bp, Homo sapiens
gtcaggactgcgggagaaggatga

SEQ ID NO: 12360 - DNA, 24 bp, Homo sapiens
aaccgcactctcacactggccttg

SEQ ID NO: 12361 - DNA, 24 bp, Homo sapiens
ggcatcggtggacaagatctcaat

SEQ ID NO: 12362 - DNA, 24 bp, Homo sapiens
gggaagaatcaagcgaagttctcc

SEQ ID NO: 12363 - DNA, 24 bp, Homo sapiens
agaaattacagaaaacctgatggc

SEQ ID NO: 12364 - DNA, 24 bp, Homo sapiens
gcttgcttgcctttgcctgggtat

SEQ ID NO: 12365 - DNA, 24 bp, Homo sapiens
tggcaatggatacatcagcttcaa

SEQ ID NO: 12366 - DNA, 24 bp, Homo sapiens
gcttgcttgcctttgcctgggtat

SEQ ID NO: 12367 - DNA, 24 bp, Homo sapiens
tggctacaggtgatctggaccaag

SEQ ID NO: 12368 - DNA, 24 bp, Homo sapiens
ttcagagcagtctagcgttggcac

SEQ ID NO: 12369 - DNA, 24 bp, Homo sapiens
atcctgattgtcggcatgtcatcc

SEQ ID NO: 12370 - DNA, 24 bp, Homo sapiens
tcaactggataaacaaagccctgg

SEQ ID NO: 12371 - DNA, 24 bp, Homo sapiens
acccaaacacgaatgatctcttta

SEQ ID NO: 12372 - DNA, 24 bp, Homo sapiens
cttcagagcagtctagcgttggca

SEQ ID NO: 12373 - DNA, 24 bp, Homo sapiens
tggctacaggtgatctggaccaag

SEQ ID NO: 12374 - DNA, 24 bp, Homo sapiens
gcttgcttgcctttgcctgggtat

SEQ ID NO: 12375 - DNA, 24 bp, Homo sapiens
gagaaggtgagagcctggaggatt

SEQ ID NO: 12376 - DNA, 24 bp, Homo sapiens
aggactgcgggagaaggatgacat

SEQ ID NO: 12377 - DNA, 24 bp, Homo sapiens
tgtcacagccacagatgttgtccg

SEQ ID NO: 12378 - DNA, 24 bp, Homo sapiens
aggaactggatgaactccctgggt

SEQ ID NO: 12379 - DNA, 24 bp, Homo sapiens
cagagtaaacaaaccgccataccc

SEQ ID NO: 12380 - DNA, 24 bp, Homo sapiens
aaggaaaccgcactctcacactgg

SEQ ID NO: 12381 - DNA, 24 bp, Homo sapiens
aggtgagacgagagaagagcggac

SEQ ID NO: 12382 - DNA, 24 bp, Homo sapiens
tgtcacagccacagatgttgtccg

SEQ ID NO: 12383 - DNA, 24 bp, Homo sapiens
aggactgcgggagaaggatgacat

SEQ ID NO: 12384 - DNA, 24 bp, Homo sapiens
cagatttcaaggtgatggtgaacg

SEQ ID NO: 12385 - DNA, 24 bp, Homo sapiens
tcagatttcaaggtgatggtgaac

SEQ ID NO: 12386 - DNA, 24 bp, Homo sapiens
ctcagatttcaaggtgatggtgaa

SEQ ID NO: 12387 - DNA, 23 bp, Homo sapiens
cgccacagctacactccaaccac

SEQ ID NO: 12388 - DNA, 23 bp, Homo sapiens
atgatccatcggtccacgagcca

SEQ ID NO: 12389 - DNA, 25 bp, Homo sapiens
ttgtctcctactccatcagcagaag

SEQ ID NO: 12390 - DNA, 24 bp, Homo sapiens
gacgccgctggattctgttcaagt

SEQ ID NO: 12391 - DNA, 24 bp, Homo sapiens
ttcttcctcaccctctgccactgt

SEQ ID NO: 12392 - DNA, 24 bp, Homo sapiens
gtgtgagagtgtctgactgaggaa

SEQ ID NO: 12393 - DNA, 24 bp, Homo sapiens
ccaagaatccagaactctcctacc

SEQ ID NO: 12394 - DNA, 24 bp, Homo sapiens
tccaccctcagtggatgataatct

SEQ ID NO: 12395 - DNA, 24 bp, Homo sapiens
ttccaccctcagtggatgataatc

SEQ ID NO: 12396 - DNA, 24 bp, Homo sapiens
cttccaccctcagtggatgataat

SEQ ID NO: 12397 - DNA, 24 bp, Homo sapiens
tccaccctcagctctaccctcagc

SEQ ID NO: 12398 - DNA, 24 bp, Homo sapiens
ttccaccctcagctctaccctcag

SEQ ID NO: 12399 - DNA, 24 bp, Homo sapiens
cttccaccctcagctctaccctca

SEQ ID NO: 12400 - DNA, 24 bp, Homo sapiens
cggatgataatcaagacacctccc

SEQ ID NO: 12401 - DNA, 24 bp, Homo sapiens
gcggatgataatcaagacacctcc

SEQ ID NO: 12402 - DNA, 24 bp, Homo sapiens
agcggatgataatcaagacacctc

SEQ ID NO: 12403 - DNA, 23 bp, Homo sapiens
gagcctcaagacacctgcggagt

SEQ ID NO: 12404 - DNA, 25 bp, Homo sapiens
gccacctcctccaactcaacaacat

SEQ ID NO: 12405 - DNA, 23 bp, Homo sapiens
ggcagcggagcatcgtcattctt

SEQ ID NO: 12406 - DNA, 24 bp, Homo sapiens
gagcatcgtcattcttcaggattg

SEQ ID NO: 12407 - DNA, 24 bp, Homo sapiens
gccacctcctccaactcaacaaca

SEQ ID NO: 12408 - DNA, 24 bp, Homo sapiens
cacctgcggagtgtctgctctatc

SEQ ID NO: 12409 - DNA, 24 bp, Homo sapiens
aatctcaagacacctgccgagtgc

SEQ ID NO: 12410 - DNA, 24 bp, Homo sapiens
agcggatgataatctcaagacacc

SEQ ID NO: 12411 - DNA, 24 bp, Homo sapiens
cacctgcggagtgtctgctctatc

SEQ ID NO: 12412 - DNA, 24 bp, Homo sapiens
gccacctcctccaactcaacaaca

SEQ ID NO: 12413 - DNA, 23 bp, Homo sapiens
tgtctgctcactccccttccacc

SEQ ID NO: 12414 - DNA, 24 bp, Homo sapiens
gcagcggagcatcgtcattcttca

SEQ ID NO: 12415 - DNA, 24 bp, Homo sapiens
gccacctcctccaactcaacaaca

SEQ ID NO: 12416 - DNA, 24 bp, Homo sapiens
gagaggcaggtgtcagaggcagag

SEQ ID NO: 12417 - DNA, 24 bp, Homo sapiens
agcggatgataatctcaagacacc

SEQ ID NO: 12418 - DNA, 24 bp, Homo sapiens
cttccaccctcagctccaccctca

SEQ ID NO: 12419 - DNA, 24 bp, Homo sapiens
cggcagtggagcatcgtcattctt

SEQ ID NO: 12420 - DNA, 24 bp, Homo sapiens
gccacctcctccaactcaacaaca

SEQ ID NO: 12421 - DNA, 24 bp, Homo sapiens
aatctcaagacacctgccgagtgc

SEQ ID NO: 12422 - DNA, 24 bp, Homo sapiens
cggcagtggagcatcgtcattctt

SEQ ID NO: 12423 - DNA, 24 bp, Homo sapiens
gccacctcctccaactcaacaaca

SEQ ID NO: 12424 - DNA, 24 bp, Homo sapiens
gcagactgtgttggtggcggtaat

SEQ ID NO: 12425 - DNA, 24 bp, Homo sapiens
cacctgcggagtgtctgctctatc

SEQ ID NO: 12426 - DNA, 24 bp, Homo sapiens
caccagccacctcctccaactcaa

SEQ ID NO: 12427 - DNA, 24 bp, Homo sapiens
gcagcggagcatcgtcattcttca

SEQ ID NO: 12428 - DNA, 24 bp, Homo sapiens
tctgctcactccccttccaccctc

SEQ ID NO: 12429 - DNA, 24 bp, Homo sapiens
gagcctcaagacacctgcggagtg

SEQ ID NO: 12430 - DNA, 24 bp, Homo sapiens
gagcatcgtcattcttcaggattg

SEQ ID NO: 12431 - DNA, 24 bp, Homo sapiens
aacaggatgggccaccagccacct

SEQ ID NO: 12432 - DNA, 24 bp, Homo sapiens
tccaccctcagcggatgataatct

SEQ ID NO: 12433 - DNA, 24 bp, Homo sapiens
ttccaccctcagcggatgataatc

SEQ ID NO: 12434 - DNA, 24 bp, Homo sapiens
cttccaccctcagcggatgataat

SEQ ID NO: 12435 - DNA, 24 bp, Homo sapiens
gagcctcaagacacctgcggagtg

SEQ ID NO: 12436 - DNA, 24 bp, Homo sapiens
gccacctcctccaactcaacaaca

SEQ ID NO: 12437 - DNA, 24 bp, Homo sapiens
gcagcggagcatcgtcattcttca

SEQ ID NO: 12438 - DNA, 24 bp, Homo sapiens
agcggatgataatctcaagacacc

SEQ ID NO: 12439 - DNA, 24 bp, Homo sapiens
accttccgagttgtctgctcactc

SEQ ID NO: 12440 - DNA, 24 bp, Homo sapiens
caccttccgagttgtctgctcact

SEQ ID NO: 12441 - DNA, 24 bp, Homo sapiens
acaccttccgagttgtctgctcac

SEQ ID NO: 12442 - DNA, 24 bp, Homo sapiens
gccacctcctccaactcaacaaca

SEQ ID NO: 12443 - DNA, 24 bp, Homo sapiens
gcagcggagcatcgtcattcttca

SEQ ID NO: 12444 - DNA, 24 bp, Homo sapiens
ggcgggcagaggactactacagat

SEQ ID NO: 12445 - DNA, 24 bp, Homo sapiens
gaggctgaggcaggagaatggcat

SEQ ID NO: 12446 - DNA, 24 bp, Homo sapiens
aacaccaatccttcacagactctt

SEQ ID NO: 12447 - DNA, 24 bp, Homo sapiens
catcctgggcaatggagcaagact

SEQ ID NO: 12448 - DNA, 24 bp, Homo sapiens
tttgaaacctggaggatggaaagg

SEQ ID NO: 12449 - DNA, 24 bp, Homo sapiens
agggtgatattatgacactgacac

SEQ ID NO: 12450 - DNA, 24 bp, Homo sapiens
agcaggcagtaagcaagaggagga

SEQ ID NO: 12451 - DNA, 24 bp, Homo sapiens
agatggagtctcgctgtgtcaccc

SEQ ID NO: 12452 - DNA, 24 bp, Homo sapiens
ccgcctcccaggttcaagtgattc

SEQ ID NO: 12453 - DNA, 24 bp, Homo sapiens
gcggcgggcagaggactactacag

SEQ ID NO: 12454 - DNA, 24 bp, Homo sapiens
ggcggcgggcagaggactactaca

SEQ ID NO: 12455 - DNA, 24 bp, Homo sapiens
cggcggcgggcagaggactactac

SEQ ID NO: 12456 - DNA, 24 bp, Homo sapiens
ggaaagaggaagaccgccaaagaa

SEQ ID NO: 12457 - DNA, 24 bp, Homo sapiens
gagaggcaggtgtcagaggcagag

SEQ ID NO: 12458 - DNA, 24 bp, Homo sapiens
gcagcggagcatcgtcattcttca

SEQ ID NO: 12459 - DNA, 24 bp, Homo sapiens
caagatctccggctacagcacaga

SEQ ID NO: 12460 - DNA, 24 bp, Homo sapiens
ccaagatctccggctacagcacag

SEQ ID NO: 12461 - DNA, 24 bp, Homo sapiens
tccaagatctccggctacagcaca

SEQ ID NO: 12462 - DNA, 23 bp, Homo sapiens
atgacacgaagaacactcgccag

SEQ ID NO: 12463 - DNA, 23 bp, Homo sapiens
aacctggccgagtttgcgggctc

SEQ ID NO: 12464 - DNA, 23 bp, Homo sapiens
cacggtgcgctgctgcctgctcg

SEQ ID NO: 12465 - DNA, 25 bp, Homo sapiens
tgagccaatgaaacctcttttcttc

SEQ ID NO: 12466 - DNA, 25 bp, Homo sapiens
gcaccacgctttctgtacagcctaa

SEQ ID NO: 12467 - DNA, 23 bp, Homo sapiens
aggcctccctagaagctgagcag

SEQ ID NO: 12468 - DNA, 24 bp, Homo sapiens
ttgaactcctgacctcgtgatcca

SEQ ID NO: 12469 - DNA, 24 bp, Homo sapiens
aagccattcctccttctgttccac

SEQ ID NO: 12470 - DNA, 24 bp, Homo sapiens
ttcctcctccattccaccgactcc

SEQ ID NO: 12471 - DNA, 24 bp, Homo sapiens
acctctgcctcccaaagtgctggg

SEQ ID NO: 12472 - DNA, 24 bp, Homo sapiens
cacctctgcctcccaaagtgctgg

SEQ ID NO: 12473 - DNA, 24 bp, Homo sapiens
ccacctctgcctcccaaagtgctg

SEQ ID NO: 12474 - DNA, 24 bp, Homo sapiens
gccctatcctcccgactctgctta

SEQ ID NO: 12475 - DNA, 24 bp, Homo sapiens
ggaccgtcgtgcccatatctcctg

SEQ ID NO: 12476 - DNA, 24 bp, Homo sapiens
taggtccgcactgtggtgactgaa

SEQ ID NO: 12477 - DNA, 24 bp, Homo sapiens
ggctcatgcctgtaatcccagcac

SEQ ID NO: 12478 - DNA, 24 bp, Homo sapiens
tggctcatgcctgtaatcccagca

SEQ ID NO: 12479 - DNA, 24 bp, Homo sapiens
gtggctcatgcctgtaatcccagc

SEQ ID NO: 12480 - DNA, 24 bp, Homo sapiens
tgggattacaggctcctcattagg

SEQ ID NO: 12481 - DNA, 24 bp, Homo sapiens
ctgggattacaggctcctcattag

SEQ ID NO: 12482 - DNA, 24 bp, Homo sapiens
gctgggattacaggctcctcatta

SEQ ID NO: 12483 - DNA, 24 bp, Homo sapiens
accacgcccaggtaattttttata

SEQ ID NO: 12484 - DNA, 24 bp, Homo sapiens
caccacgcccaggtaattttttat

SEQ ID NO: 12485 - DNA, 24 bp, Homo sapiens
ccaccacgcccaggtaatttttta

SEQ ID NO: 12486 - DNA, 24 bp, Homo sapiens
gaagcaggaagtggtgaagacgca

SEQ ID NO: 12487 - DNA, 24 bp, Homo sapiens
cggcaagatggcagaagtagagca

SEQ ID NO: 12488 - DNA, 24 bp, Homo sapiens
gaccttccgcaagttcacctaccg

SEQ ID NO: 12489 - DNA, 23 bp, Homo sapiens
cgggaggcagaggttgcagtgag

SEQ ID NO: 12490 - DNA, 24 bp, Homo sapiens
tgaactcctgacctcgtgatccgc

SEQ ID NO: 12491 - DNA, 24 bp, Homo sapiens
agcaattctccttcctcagcctcc

SEQ ID NO: 12492 - DNA, 24 bp, Homo sapiens
aattctcctgcctcagcctcccaa

SEQ ID NO: 12493 - DNA, 24 bp, Homo sapiens
gccacctcagcctcccagagtgct

SEQ ID NO: 12494 - DNA, 24 bp, Homo sapiens
cgccacctcagcctcccagagtgc

SEQ ID NO: 12495 - DNA, 24 bp, Homo sapiens
ccgccacctcagcctcccagagtg

SEQ ID NO: 12496 - DNA, 24 bp, Homo sapiens
gcacagtccaggctttggagagaa

SEQ ID NO: 12497 - DNA, 24 bp, Homo sapiens
agcacagtccaggctttggagaga

SEQ ID NO: 12498 - DNA, 24 bp, Homo sapiens
cagcacagtccaggctttggagag

SEQ ID NO: 12499 - DNA, 24 bp, Homo sapiens
ccagttctctgggtcgtctaagga

SEQ ID NO: 12500 - DNA, 24 bp, Homo sapiens
accagttctctgggtcgtctaagg

SEQ ID NO: 12501 - DNA, 24 bp, Homo sapiens
taccagttctctgggtcgtctaag

SEQ ID NO: 12502 - DNA, 24 bp, Homo sapiens
ttatttcacaggttgagggcacca

SEQ ID NO: 12503 - DNA, 24 bp, Homo sapiens
tttatttcacaggttgagggcacc

SEQ ID NO: 12504 - DNA, 24 bp, Homo sapiens
ctttatttcacaggttgagggcac

SEQ ID NO: 12505 - DNA, 24 bp, Homo sapiens
acaggcacagctccatcgttacaa

SEQ ID NO: 12506 - DNA, 24 bp, Homo sapiens
ctttagacccagctcctgcctccc

SEQ ID NO: 12507 - DNA, 24 bp, Homo sapiens
agatgagcctactgccccacaaca

SEQ ID NO: 12508 - DNA, 24 bp, Homo sapiens
caggcccagaactttctccaatca

SEQ ID NO: 12509 - DNA, 24 bp, Homo sapiens
ccaggcccagaactttctccaatc

SEQ ID NO: 12510 - DNA, 24 bp, Homo sapiens
tccaggcccagaactttctccaat

SEQ ID NO: 12511 - DNA, 24 bp, Homo sapiens
caggccctgaactttctcaagtcg

SEQ ID NO: 12512 - DNA, 24 bp, Homo sapiens
ccaggccctgaactttctcaagtc

SEQ ID NO: 12513 - DNA, 24 bp, Homo sapiens
tccaggccctgaactttctcaagt

SEQ ID NO: 12514 - DNA, 24 bp, Homo sapiens
acgcccactgattctacattatgc

SEQ ID NO: 12515 - DNA, 24 bp, Homo sapiens
cgtggctgagactacaggtgcttg

SEQ ID NO: 12516 - DNA, 24 bp, Homo sapiens
ggctgaagcgatcctcccatctca

SEQ ID NO: 12517 - DNA, 24 bp, Homo sapiens
ctctgcctcccgtcggcctctaca

SEQ ID NO: 12518 - DNA, 24 bp, Homo sapiens
cctctgcctcccgtcggcctctac

SEQ ID NO: 12519 - DNA, 24 bp, Homo sapiens
gcctctgcctcccgtcggcctcta

SEQ ID NO: 12520 - DNA, 24 bp, Homo sapiens
ccacaggcacagctccatcgttac

SEQ ID NO: 12521 - DNA, 24 bp, Homo sapiens
gcagtctccgcagatgagcctact

SEQ ID NO: 12522 - DNA, 24 bp, Homo sapiens
ccaatcagcctctacagaccaagc

SEQ ID NO: 12523 - DNA, 24 bp, Homo sapiens
acgcccactgattctacattatgc

SEQ ID NO: 12524 - DNA, 24 bp, Homo sapiens
ccaatcagcctctacagaccaagc

SEQ ID NO: 12525 - DNA, 24 bp, Homo sapiens
gcagtctccgcagatgagcctact

SEQ ID NO: 12526 - DNA, 24 bp, Homo sapiens
ggctggagtgtagtagtgctatca

SEQ ID NO: 12527 - DNA, 24 bp, Homo sapiens
cgtggctgagactacaggtgcttg

SEQ ID NO: 12528 - DNA, 24 bp, Homo sapiens
ccaatcagcctctacagaccaagc

SEQ ID NO: 12529 - DNA, 24 bp, Homo sapiens
gcctcacagcagattcttcacgcc

SEQ ID NO: 12530 - DNA, 24 bp, Homo sapiens
ccaatcagcctctacagaccaagc

SEQ ID NO: 12531 - DNA, 24 bp, Homo sapiens
gcagtctccgcagatgagcctact

SEQ ID NO: 12532 - DNA, 24 bp, Homo sapiens
gcctcacagcagattcttcacgcc

SEQ ID NO: 12533 - DNA, 24 bp, Homo sapiens
ctcctgcctcccagccttctctcc

SEQ ID NO: 12534 - DNA, 24 bp, Homo sapiens
ccacaggcacagctccatcgttac

SEQ ID NO: 12535 - DNA, 24 bp, Homo sapiens
gagcacagagccaagacctgaacc

SEQ ID NO: 12536 - DNA, 24 bp, Homo sapiens
cccgagccactgtccttcccacga

SEQ ID NO: 12537 - DNA, 24 bp, Homo sapiens
acttgcctcagctccagactttgc

SEQ ID NO: 12538 - DNA, 24 bp, Homo sapiens
ttcagtgtctacacaacagccacc

SEQ ID NO: 12539 - DNA, 24 bp, Homo sapiens
tccagtgcccttccatctatctct

SEQ ID NO: 12540 - DNA, 24 bp, Homo sapiens
tcctcctccaccacctcttgatga

SEQ ID NO: 12541 - DNA, 24 bp, Homo sapiens
tcctcctccaccacctcttgatga

SEQ ID NO: 12542 - DNA, 24 bp, Homo sapiens
acgctgagattgactccttgacca

SEQ ID NO: 12543 - DNA, 24 bp, Homo sapiens
ggttcaacagcctctcctccagtt

SEQ ID NO: 12544 - DNA, 24 bp, Homo sapiens
gtagccaaccaaatccacactctg

SEQ ID NO: 12545 - DNA, 24 bp, Homo sapiens
ccaaccctggaatcaacacctttc

SEQ ID NO: 12546 - DNA, 24 bp, Homo sapiens
atggagaagtaaaggatggtgctt

SEQ ID NO: 12547 - DNA, 24 bp, Homo sapiens
gaagatgacaaccaggcacaggaa

SEQ ID NO: 12548 - DNA, 24 bp, Homo sapiens
gggagccatcaatcaggaaagccg

SEQ ID NO: 12549 - DNA, 24 bp, Homo sapiens
agcacgctgaattagaagaactga

SEQ ID NO: 12550 - DNA, 24 bp, Homo sapiens
cctcctgccaggcctcctgatcac

SEQ ID NO: 12551 - DNA, 24 bp, Homo sapiens
tcctcctgccaggcctcctgatca

SEQ ID NO: 12552 - DNA, 24 bp, Homo sapiens
ttcctcctgccaggcctcctgatc

SEQ ID NO: 12553 - DNA, 24 bp, Homo sapiens
catccccaaaggcattatctgcct

SEQ ID NO: 12554 - DNA, 24 bp, Homo sapiens
tcatccccaaaggcattatctgcc

SEQ ID NO: 12555 - DNA, 24 bp, Homo sapiens
gtcatccccaaaggcattatctgc

SEQ ID NO: 12556 - DNA, 24 bp, Homo sapiens
cggaccctgaggtctatgacccct

SEQ ID NO: 12557 - DNA, 24 bp, Homo sapiens
ccggaccctgaggtctatgacccc

SEQ ID NO: 12558 - DNA, 24 bp, Homo sapiens
gccggaccctgaggtctatgaccc

SEQ ID NO: 12559 - DNA, 24 bp, Homo sapiens
ggatgctgacgcctgccttccatt

SEQ ID NO: 12560 - DNA, 24 bp, Homo sapiens
gtgctggtgaaaagtggagccgcc

SEQ ID NO: 12561 - DNA, 24 bp, Homo sapiens
ggctcctgctgagtgctggtgaaa

SEQ ID NO: 12562 - DNA, 24 bp, Homo sapiens
ggatgctgacgcctgccttccatt

SEQ ID NO: 12563 - DNA, 24 bp, Homo sapiens
ttgacagccattgccaggagaagc

SEQ ID NO: 12564 - DNA, 24 bp, Homo sapiens
ggatgctgacgcctgccttccatt

SEQ ID NO: 12565 - DNA, 24 bp, Homo sapiens
ttgacagccattgccaggagaagc

SEQ ID NO: 12566 - DNA, 24 bp, Homo sapiens
agacaccagcagatcctcctgtac

SEQ ID NO: 12567 - DNA, 24 bp, Homo sapiens
tgaccatgtgcattaaggagagcc

SEQ ID NO: 12568 - DNA, 24 bp, Homo sapiens
ccaagacattgtgctcccagacgg

SEQ ID NO: 12569 - DNA, 24 bp, Homo sapiens
gaacccatcacaacccagccgtgt

SEQ ID NO: 12570 - DNA, 24 bp, Homo sapiens
cccaagacattgtgctcccagacg

SEQ ID NO: 12571 - DNA, 24 bp, Homo sapiens
tgaccatgtgcattaaggagagcc

SEQ ID NO: 12572 - DNA, 24 bp, Homo sapiens
ccccagtccctgccgtctctcgct

SEQ ID NO: 12573 - DNA, 24 bp, Homo sapiens
ccgctgcgtgggtgagccgggctt

SEQ ID NO: 12574 - DNA, 24 bp, Homo sapiens
cccgctgcgtgggtgagccgggct

SEQ ID NO: 12575 - DNA, 24 bp, Homo sapiens
gcccgctgcgtgggtgagccgggc

SEQ ID NO: 12576 - DNA, 24 bp, Homo sapiens
ctcccaccagacgctcaccattca

SEQ ID NO: 12577 - DNA, 24 bp, Homo sapiens
ccaccacctgaggacacagaggaa

SEQ ID NO: 12578 - DNA, 24 bp, Homo sapiens
cggtgagtgaggagaggtcagtgc

SEQ ID NO: 12579 - DNA, 24 bp, Homo sapiens
tttctgctcagattgcagagggaa

SEQ ID NO: 12580 - DNA, 24 bp, Homo sapiens
ttttctgctcagattgcagaggga

SEQ ID NO: 12581 - DNA, 24 bp, Homo sapiens
cttttctgctcagattgcagaggg

SEQ ID NO: 12582 - DNA, 24 bp, Homo sapiens
tgtcttcacaggtggtttttcaag

SEQ ID NO: 12583 - DNA, 24 bp, Homo sapiens
atgtcttcacaggtggtttttcaa

SEQ ID NO: 12584 - DNA, 24 bp, Homo sapiens
aatgtcttcacaggtggtttttca

SEQ ID NO: 12585 - DNA, 24 bp, Homo sapiens
agtctggatgggttactataacaa

SEQ ID NO: 12586 - DNA, 24 bp, Homo sapiens
aagtctggatgggttactataaca

SEQ ID NO: 12587 - DNA, 24 bp, Homo sapiens
gaagtctggatgggttactataac

SEQ ID NO: 12588 - DNA, 24 bp, Homo sapiens
gcagaagattggagaaggcttgta

SEQ ID NO: 12589 - DNA, 24 bp, Homo sapiens
atgggataaagatgcctgggagat

SEQ ID NO: 12590 - DNA, 24 bp, Homo sapiens
gtccatcaagttggtgaaaaggct

SEQ ID NO: 12591 - DNA, 24 bp, Homo sapiens
aagtgctgggaattacaggcgtga

SEQ ID NO: 12592 - DNA, 24 bp, Homo sapiens
aaagtgctgggaattacaggcgtg

SEQ ID NO: 12593 - DNA, 24 bp, Homo sapiens
caaagtgctgggaattacaggcgt

SEQ ID NO: 12594 - DNA, 24 bp, Homo sapiens
cgcgctgcccggccggctcctcgt

SEQ ID NO: 12595 - DNA, 24 bp, Homo sapiens
tcgcgctgcccggccggctcctcg

SEQ ID NO: 12596 - DNA, 24 bp, Homo sapiens
ctcgcgctgcccggccggctcctc

SEQ ID NO: 12597 - DNA, 25 bp, Homo sapiens
tccgaagagagccctgataacattg

SEQ ID NO: 12598 - DNA, 25 bp, Homo sapiens
agttgtatctgtggagttcattgcc

SEQ ID NO: 12599 - DNA, 25 bp, Homo sapiens
gactcaccttcagccaggaaccaag

SEQ ID NO: 12600 - DNA, 25 bp, Homo sapiens
gcttgtcctccagaacccatccttg

SEQ ID NO: 12601 - DNA, 25 bp, Homo sapiens
agaaggattgttggtgtccgctacc

SEQ ID NO: 12602 - DNA, 23 bp, Homo sapiens
cctgctgaagttgcggagacctg

SEQ ID NO: 12603 - DNA, 23 bp, Homo sapiens
cctcagaagtctcaatgcctact

SEQ ID NO: 12604 - DNA, 25 bp, Homo sapiens
gcttgtcctccagaacccatccttg

SEQ ID NO: 12605 - DNA, 24 bp, Homo sapiens
cacagaccagcctcaagacaagcc

SEQ ID NO: 12606 - DNA, 25 bp, Homo sapiens
agttgtatctgtggagttcattgcc

SEQ ID NO: 12607 - DNA, 25 bp, Homo sapiens
tccgaagagagccctgataacattg

SEQ ID NO: 12608 - DNA, 25 bp, Homo sapiens
acttcccattggcgtctttctcaca

SEQ ID NO: 12609 - DNA, 24 bp, Homo sapiens
gcagaataccgaaggcagacggta

SEQ ID NO: 12610 - DNA, 24 bp, Homo sapiens
agcagaataccgaaggcagacggt

SEQ ID NO: 12611 - DNA, 24 bp, Homo sapiens
gagcagaataccgaaggcagacgg

SEQ ID NO: 12612 - DNA, 24 bp, Homo sapiens
tctcatgcctcagcttcccgagta

SEQ ID NO: 12613 - DNA, 24 bp, Homo sapiens
ccactgcccagggccggtattacc

SEQ ID NO: 12614 - DNA, 24 bp, Homo sapiens
gccactgcccagggccggtattac

SEQ ID NO: 12615 - DNA, 24 bp, Homo sapiens
ggccactgcccagggccggtatta

SEQ ID NO: 12616 - DNA, 24 bp, Homo sapiens
gaagcccactgccattaagactga

SEQ ID NO: 12617 - DNA, 24 bp, Homo sapiens
agaagcccactgccattaagactg

SEQ ID NO: 12618 - DNA, 24 bp, Homo sapiens
aagaagcccactgccattaagact

SEQ ID NO: 12619 - DNA, 24 bp, Homo sapiens
cggccaaggatgtggctccgtcca

SEQ ID NO: 12620 - DNA, 24 bp, Homo sapiens
ccggccaaggatgtggctccgtcc

SEQ ID NO: 12621 - DNA, 24 bp, Homo sapiens
cccggccaaggatgtggctccgtc

SEQ ID NO: 12622 - DNA, 24 bp, Homo sapiens
tgggcaaggatgtgactccacctc

SEQ ID NO: 12623 - DNA, 24 bp, Homo sapiens
ctgggcaaggatgtgactccacct

SEQ ID NO: 12624 - DNA, 24 bp, Homo sapiens
tctgggcaaggatgtgactccacc

SEQ ID NO: 12625 - DNA, 23 bp, Homo sapiens
tgattctccttcctcagcctcct

SEQ ID NO: 12626 - DNA, 23 bp, Homo sapiens
ggctggagtgcaatggcgcgatc

SEQ ID NO: 12627 - DNA, 23 bp, Homo sapiens
cactgcgatctccgcctcctggg

SEQ ID NO: 12628 - DNA, 24 bp, Homo sapiens
gccagtctcctcaccacaaagtgc

SEQ ID NO: 12629 - DNA, 24 bp, Homo sapiens
gacgctacagtgaccatgctggac

SEQ ID NO: 12630 - DNA, 24 bp, Homo sapiens
ttccttctgttgtggcgtatccga

SEQ ID NO: 12631 - DNA, 24 bp, Homo sapiens
catgaaggacaggtggatcaatgc

SEQ ID NO: 12632 - DNA, 24 bp, Homo sapiens
acagactgtgaaaaccttctcaaa

SEQ ID NO: 12633 - DNA, 24 bp, Homo sapiens
ctggtgctaaatccaattaaacgc

SEQ ID NO: 12634 - DNA, 24 bp, Homo sapiens
ctacctccctgaggagctgagtgc

SEQ ID NO: 12635 - DNA, 24 bp, Homo sapiens
cctacctccctgaggagctgagtg

SEQ ID NO: 12636 - DNA, 24 bp, Homo sapiens
gcctacctccctgaggagctgagt

SEQ ID NO: 12637 - DNA, 24 bp, Homo sapiens
tagtctttccttgctcagccctag

SEQ ID NO: 12638 - DNA, 24 bp, Homo sapiens
tggccaaagacaatgttcctttcc

SEQ ID NO: 12639 - DNA, 24 bp, Homo sapiens
ttctgtccaaggtgtgctcggaaa

SEQ ID NO: 12640 - DNA, 24 bp, Homo sapiens
cttctgtccaaggtgtgctcggaa

SEQ ID NO: 12641 - DNA, 24 bp, Homo sapiens
acttctgtccaaggtgtgctcgga

SEQ ID NO: 12642 - DNA, 24 bp, Homo sapiens
gggaggaggtggtgagaactctgg

SEQ ID NO: 12643 - DNA, 24 bp, Homo sapiens
gtctcacctgggattctctgtctc

SEQ ID NO: 12644 - DNA, 24 bp, Homo sapiens
tgacttctgtccaaggtactgtgt

SEQ ID NO: 12645 - DNA, 25 bp, Homo sapiens
tgtgtactcctgtccttcatcgtca

SEQ ID NO: 12646 - DNA, 23 bp, Homo sapiens
aatgccacaccttcatttcaagc

SEQ ID NO: 12647 - DNA, 24 bp, Homo sapiens
attcattgaaaggccgttgctcca

SEQ ID NO: 12648 - DNA, 24 bp, Homo sapiens
gattcattgaaaggccgttgctcc

SEQ ID NO: 12649 - DNA, 24 bp, Homo sapiens
tgattcattgaaaggccgttgctc

SEQ ID NO: 12650 - DNA, 24 bp, Homo sapiens
tacaacccgtggtaagcatgtttt

SEQ ID NO: 12651 - DNA, 24 bp, Homo sapiens
ttacaacccgtggtaagcatgttt

SEQ ID NO: 12652 - DNA, 24 bp, Homo sapiens
attacaacccgtggtaagcatgtt

SEQ ID NO: 12653 - DNA, 24 bp, Homo sapiens
acagacttgaggtatgtcgagagt

SEQ ID NO: 12654 - DNA, 24 bp, Homo sapiens
gacagacttgaggtatgtcgagag

SEQ ID NO: 12655 - DNA, 24 bp, Homo sapiens
agacagacttgaggtatgtcgaga

SEQ ID NO: 12656 - DNA, 24 bp, Homo sapiens
ccctccgaaagttcccatggtgca

SEQ ID NO: 12657 - DNA, 24 bp, Homo sapiens
tccctccgaaagttcccatggtgc

SEQ ID NO: 12658 - DNA, 24 bp, Homo sapiens
ttccctccgaaagttcccatggtg

SEQ ID NO: 12659 - DNA, 24 bp, Homo sapiens
cagccaaccagatacccataatat

SEQ ID NO: 12660 - DNA, 24 bp, Homo sapiens
acagccaaccagatacccataata

SEQ ID NO: 12661 - DNA, 24 bp, Homo sapiens
cacagccaaccagatacccataat

SEQ ID NO: 12662 - DNA, 25 bp, Homo sapiens
tggacgcaataacttgattcagcag

SEQ ID NO: 12663 - DNA, 25 bp, Homo sapiens
caactagccaatgccatgatgcctg

SEQ ID NO: 12664 - DNA, 24 bp, Homo sapiens
catcagcagccgcctttaatccct

SEQ ID NO: 12665 - DNA, 24 bp, Homo sapiens
actgtgtccgcagcaacaacatct

SEQ ID NO: 12666 - DNA, 23 bp, Homo sapiens
ctgcaacagccacagccaaccag

SEQ ID NO: 12667 - DNA, 23 bp, Homo sapiens
agccactgtgtccgcagcaacaa

SEQ ID NO: 12668 - DNA, 23 bp, Homo sapiens
ccacaagtgttcccttcgctgca

SEQ ID NO: 12669 - DNA, 24 bp, Homo sapiens
gttgcaggaaaacaagctcagggc

SEQ ID NO: 12670 - DNA, 24 bp, Homo sapiens
aataccaacaggctctagccaaca

SEQ ID NO: 12671 - DNA, 24 bp, Homo sapiens
caataccaacaggctctagccaac

SEQ ID NO: 12672 - DNA, 24 bp, Homo sapiens
ccaataccaacaggctctagccaa

SEQ ID NO: 12673 - DNA, 24 bp, Homo sapiens
actgtgtccgcagcaacaacatct

SEQ ID NO: 12674 - DNA, 24 bp, Homo sapiens
gcagttacaacagcatacagcatt

SEQ ID NO: 12675 - DNA, 23 bp, Homo sapiens
ttccaataccaacaggctctagc

SEQ ID NO: 12676 - DNA, 25 bp, Homo sapiens
gtgactctaaacaaagaagaaagca

SEQ ID NO: 12677 - DNA, 24 bp, Homo sapiens
tcatcagatgcatgataaaccaaa

SEQ ID NO: 12678 - DNA, 25 bp, Homo sapiens
ttgggtgggttaagtacatgggtga

SEQ ID NO: 12679 - DNA, 25 bp, Homo sapiens
tcagtttctgccaatttcagtggtt

SEQ ID NO: 12680 - DNA, 25 bp, Homo sapiens
aaacaggcaaaccaaacagcacact

SEQ ID NO: 12681 - DNA, 24 bp, Homo sapiens
aaacgcagttcaaatttcatggtt

SEQ ID NO: 12682 - DNA, 25 bp, Homo sapiens
aatgtgataatgggcacttgtttaa

SEQ ID NO: 12683 - DNA, 23 bp, Homo sapiens
gtgtatccagccttcactccagc

SEQ ID NO: 12684 - DNA, 25 bp, Homo sapiens
gcacttatcagcaaccctaccactt

SEQ ID NO: 12685 - DNA, 24 bp, Homo sapiens
acacccccagcctcagcctcccaa

SEQ ID NO: 12686 - DNA, 24 bp, Homo sapiens
gacacccccagcctcagcctccca

SEQ ID NO: 12687 - DNA, 24 bp, Homo sapiens
ggacacccccagcctcagcctccc

SEQ ID NO: 12688 - DNA, 24 bp, Homo sapiens
cctaccagccgatccagtctccca

SEQ ID NO: 12689 - DNA, 24 bp, Homo sapiens
acctaccagccgatccagtctccc

SEQ ID NO: 12690 - DNA, 24 bp, Homo sapiens
gacctaccagccgatccagtctcc

SEQ ID NO: 12691 - DNA, 23 bp, Homo sapiens
tggagatgaggcgagaggcttgg

SEQ ID NO: 12692 - DNA, 25 bp, Homo sapiens
cgtctgagaatggtggatgtggtgg

SEQ ID NO: 12693 - DNA, 24 bp, Homo sapiens
aggactcagagaccagcagatgtg

SEQ ID NO: 12694 - DNA, 24 bp, Homo sapiens
cgctgtgaaaggctacctcggacc

SEQ ID NO: 12695 - DNA, 24 bp, Homo sapiens
ccgctgtgaaaggctacctcggac

SEQ ID NO: 12696 - DNA, 24 bp, Homo sapiens
gccgctgtgaaaggctacctcgga

SEQ ID NO: 12697 - DNA, 24 bp, Homo sapiens
ggtggccatgctgggaagaccatc

SEQ ID NO: 12698 - DNA, 24 bp, Homo sapiens
gatccagctcgagtcaacgtccct

SEQ ID NO: 12699 - DNA, 24 bp, Homo sapiens
acaggaaacggaatgtacctactt

SEQ ID NO: 12700 - DNA, 24 bp, Homo sapiens
aggtgttgtggaatgttccttcgt

SEQ ID NO: 12701 - DNA, 24 bp, Homo sapiens
cgctttgtcttctcccttgtggat

SEQ ID NO: 12702 - DNA, 24 bp, Homo sapiens
caatcagcaggaatcatcggactc

SEQ ID NO: 12703 - DNA, 24 bp, Homo sapiens
tcaatcagcaggaatcatcggact

SEQ ID NO: 12704 - DNA, 24 bp, Homo sapiens
gtcaatcagcaggaatcatcggac

SEQ ID NO: 12705 - DNA, 24 bp, Homo sapiens
tacaccaactcctgcctcagcctc

SEQ ID NO: 12706 - DNA, 24 bp, Homo sapiens
ttacaccaactcctgcctcagcct

SEQ ID NO: 12707 - DNA, 24 bp, Homo sapiens
tttacaccaactcctgcctcagcc

SEQ ID NO: 12708 - DNA, 24 bp, Homo sapiens
ggaaccgacaggtgactttcacca

SEQ ID NO: 12709 - DNA, 24 bp, Homo sapiens
cggaaccgacaggtgactttcacc

SEQ ID NO: 12710 - DNA, 24 bp, Homo sapiens
gcggaaccgacaggtgactttcac

SEQ ID NO: 12711 - DNA, 24 bp, Homo sapiens
ctacaacacagattaccagttgac

SEQ ID NO: 12712 - DNA, 24 bp, Homo sapiens
cctacaacacagattaccagttga

SEQ ID NO: 12713 - DNA, 24 bp, Homo sapiens
gcctacaacacagattaccagttg

SEQ ID NO: 12714 - DNA, 24 bp, Homo sapiens
cctccatgcagattaccagttgac

SEQ ID NO: 12715 - DNA, 24 bp, Homo sapiens
tcctccatgcagattaccagttga

SEQ ID NO: 12716 - DNA, 24 bp, Homo sapiens
ttcctccatgcagattaccagttg

SEQ ID NO: 12717 - DNA, 24 bp, Homo sapiens
aacttctgcaggacattggagaca

SEQ ID NO: 12718 - DNA, 24 bp, Homo sapiens
gaacttctgcaggacattggagac

SEQ ID NO: 12719 - DNA, 24 bp, Homo sapiens
ggaacttctgcaggacattggaga

SEQ ID NO: 12720 - DNA, 24 bp, Homo sapiens
agaagtcagagtttgtggagaaga

SEQ ID NO: 12721 - DNA, 24 bp, Homo sapiens
taaaacaaaagatccaactcctcc

SEQ ID NO: 12722 - DNA, 24 bp, Homo sapiens
ccctgaaaagtggaccactcctca

SEQ ID NO: 12723 - DNA, 24 bp, Homo sapiens
aggggagtgagtatttctaaattt

SEQ ID NO: 12724 - DNA, 24 bp, Homo sapiens
caggggagtgagtatttctaaatt

SEQ ID NO: 12725 - DNA, 24 bp, Homo sapiens
tcaggggagtgagtatttctaaat

SEQ ID NO: 12726 - DNA, 24 bp, Homo sapiens
ccggaaagttggggtgaagctaag

SEQ ID NO: 12727 - DNA, 24 bp, Homo sapiens
tccggaaagttggggtgaagctaa

SEQ ID NO: 12728 - DNA, 24 bp, Homo sapiens
ctccggaaagttggggtgaagcta

SEQ ID NO: 12729 - DNA, 24 bp, Homo sapiens
acaaaaaattggaaggcaacagcc

SEQ ID NO: 12730 - DNA, 24 bp, Homo sapiens
gacaaaaaattggaaggcaacagc

SEQ ID NO: 12731 - DNA, 24 bp, Homo sapiens
ggacaaaaaattggaaggcaacag

SEQ ID NO: 12732 - DNA, 24 bp, Homo sapiens
gattcgcaacattgaggagcacgc

SEQ ID NO: 12733 - DNA, 24 bp, Homo sapiens
acgacatcaccaacgagaagtcct

SEQ ID NO: 12734 - DNA, 24 bp, Homo sapiens
tggcgaagacctacgattacctgt

SEQ ID NO: 12735 - DNA, 24 bp, Homo sapiens
ctcactacagcctcagcctcccag

SEQ ID NO: 12736 - DNA, 24 bp, Homo sapiens
caggtgatcccatctcagcctcct

SEQ ID NO: 12737 - DNA, 24 bp, Homo sapiens
gaaaccctcaatctgtcccagaac

SEQ ID NO: 12738 - DNA, 24 bp, Homo sapiens
ggaaaccctcaatctgtcccagaa

SEQ ID NO: 12739 - DNA, 24 bp, Homo sapiens
tggaaaccctcaatctgtcccaga

SEQ ID NO: 12740 - DNA, 24 bp, Homo sapiens
catctaccatggtgaggtgcccca

SEQ ID NO: 12741 - DNA, 24 bp, Homo sapiens
tcatctaccatggtgaggtgcccc

SEQ ID NO: 12742 - DNA, 24 bp, Homo sapiens
ttcatctaccatggtgaggtgccc

SEQ ID NO: 12743 - DNA, 24 bp, Homo sapiens
ccaccactgtcaggatgaaggcta

SEQ ID NO: 12744 - DNA, 24 bp, Homo sapiens
tcagcaaccagaccaatcttctca

SEQ ID NO: 12745 - DNA, 24 bp, Homo sapiens
tcgccagaggattgcttccatatt

SEQ ID NO: 12746 - DNA, 24 bp, Homo sapiens
cctgagggacccatccagtttgtc

SEQ ID NO: 12747 - DNA, 24 bp, Homo sapiens
tggcaaatctctgaggctggaaca

SEQ ID NO: 12748 - DNA, 24 bp, Homo sapiens
atgcctgaacctgccctgacctcc

SEQ ID NO: 12749 - DNA, 24 bp, Homo sapiens
ggcaatcaagggacccagatcacg

SEQ ID NO: 12750 - DNA, 24 bp, Homo sapiens
acagagcaagttactcagatggaa

SEQ ID NO: 12751 - DNA, 24 bp, Homo sapiens
atggctttcgaggtgaggctttgg

SEQ ID NO: 12752 - DNA, 24 bp, Homo sapiens
aatccacaacaagtctgacctcgt

SEQ ID NO: 12753 - DNA, 24 bp, Homo sapiens
ccagatggttcgtacagattcccg

SEQ ID NO: 12754 - DNA, 24 bp, Homo sapiens
ggctaggcagcaagatgaggagat

SEQ ID NO: 12755 - DNA, 24 bp, Homo sapiens
gagtgccgtcctccagtcgtagag

SEQ ID NO: 12756 - DNA, 24 bp, Homo sapiens
accattgcccatagtccaacatct

SEQ ID NO: 12757 - DNA, 24 bp, Homo sapiens
ccatcaccagaccgacctcctcat

SEQ ID NO: 12758 - DNA, 24 bp, Homo sapiens
gcaagatagtggagtgccgtcctc

SEQ ID NO: 12759 - DNA, 24 bp, Homo sapiens
agagccggatatcaacagcactgt

SEQ ID NO: 12760 - DNA, 24 bp, Homo sapiens
tgatgaaaacaggaccattgccca

SEQ ID NO: 12761 - DNA, 24 bp, Homo sapiens
gtaaacatgtggtcgaggatttga

SEQ ID NO: 12762 - DNA, 24 bp, Homo sapiens
agtaaacatgtggtcgaggatttg

SEQ ID NO: 12763 - DNA, 24 bp, Homo sapiens
gagtaaacatgtggtcgaggattt

SEQ ID NO: 12764 - DNA, 24 bp, Homo sapiens
aacctacgatgatggtatttgcaa

SEQ ID NO: 12765 - DNA, 24 bp, Homo sapiens
caacctacgatgatggtatttgca

SEQ ID NO: 12766 - DNA, 24 bp, Homo sapiens
gcaacctacgatgatggtatttgc

SEQ ID NO: 12767 - DNA, 24 bp, Homo sapiens
cataaaatcagctgctcgactgat

SEQ ID NO: 12768 - DNA, 24 bp, Homo sapiens
gcataaaatcagctgctcgactga

SEQ ID NO: 12769 - DNA, 24 bp, Homo sapiens
tgcataaaatcagctgctcgactg

SEQ ID NO: 12770 - DNA, 25 bp, Homo sapiens
tccaaagccaaagaagaaacagcga

SEQ ID NO: 12771 - DNA, 23 bp, Homo sapiens
ctcggtccttgtcctgctcctca

SEQ ID NO: 12772 - DNA, 25 bp, Homo sapiens
gctgtgagaatgatcgcactctatg

SEQ ID NO: 12773 - DNA, 24 bp, Homo sapiens
gcccagcagtccaactcattgaac

SEQ ID NO: 12774 - DNA, 24 bp, Homo sapiens
ggcatcggcatggtcataggacac

SEQ ID NO: 12775 - DNA, 25 bp, Homo sapiens
catggcttcgatgacaatggcagaa

SEQ ID NO: 12776 - DNA, 23 bp, Homo sapiens
ctctcggtccttgtcctgctcct

SEQ ID NO: 12777 - DNA, 25 bp, Homo sapiens
tccaaagccaaagaagaaacagcga

SEQ ID NO: 12778 - DNA, 23 bp, Homo sapiens
catagctgtgagaatgatcgcac

SEQ ID NO: 12779 - DNA, 25 bp, Homo sapiens
atgccaccactgagccttgtagaga

SEQ ID NO: 12780 - DNA, 25 bp, Homo sapiens
aatatgcttgcggaggctggttgaa

SEQ ID NO: 12781 - DNA, 23 bp, Homo sapiens
ttcccgagaccagctcccgttac

SEQ ID NO: 12782 - DNA, 25 bp, Homo sapiens
aatatgcttgcggaggctggttgaa

SEQ ID NO: 12783 - DNA, 25 bp, Homo sapiens
atgccaccactgagccttgtagaga

SEQ ID NO: 12784 - DNA, 25 bp, Homo sapiens
gctgtgagaatgatcgcactctatg

SEQ ID NO: 12785 - DNA, 25 bp, Homo sapiens
ctattgatagcagaggtggagaacc

SEQ ID NO: 12786 - DNA, 23 bp, Homo sapiens
ttcccgagaccagctcccgttac

SEQ ID NO: 12787 - DNA, 25 bp, Homo sapiens
aatatgcttgcggaggctggttgaa

SEQ ID NO: 12788 - DNA, 23 bp, Homo sapiens
tcagaaacagcaacttggagacg

SEQ ID NO: 12789 - DNA, 23 bp, Homo sapiens
gacctcacttggatggatgccga

SEQ ID NO: 12790 - DNA, 25 bp, Homo sapiens
gatcggctatcctgatgacattgtt

SEQ ID NO: 12791 - DNA, 23 bp, Homo sapiens
gacctcacttggatggatgccga

SEQ ID NO: 12792 - DNA, 25 bp, Homo sapiens
aagatgagtggataagtggagcagc

SEQ ID NO: 12793 - DNA, 24 bp, Homo sapiens
gcccagcagtccaactcattgaac

SEQ ID NO: 12794 - DNA, 25 bp, Homo sapiens
aagatgagtggataagtggagcagc

SEQ ID NO: 12795 - DNA, 24 bp, Homo sapiens
gcccagcagtccaactcattgaac

SEQ ID NO: 12796 - DNA, 24 bp, Homo sapiens
ggcatcggcatggtcataggacac

SEQ ID NO: 12797 - DNA, 25 bp, Homo sapiens
gatcggctatcctgatgacattgtt

SEQ ID NO: 12798 - DNA, 23 bp, Homo sapiens
gacctcacttggatggatgccga

SEQ ID NO: 12799 - DNA, 25 bp, Homo sapiens
aatgctgtggggaggctttatgtgg

SEQ ID NO: 12800 - DNA, 25 bp, Homo sapiens
acaacctcagaaacagcaacttgga

SEQ ID NO: 12801 - DNA, 25 bp, Homo sapiens
gatcggctatcctgatgacattgtt

SEQ ID NO: 12802 - DNA, 23 bp, Homo sapiens
gacctcacttggatggatgccga

SEQ ID NO: 12803 - DNA, 25 bp, Homo sapiens
acaacctcagaaacagcaacttgga

SEQ ID NO: 12804 - DNA, 25 bp, Homo sapiens
agccaaagtaaacaactgaagaagc

SEQ ID NO: 12805 - DNA, 25 bp, Homo sapiens
gatcggctatcctgatgacattgtt

SEQ ID NO: 12806 - DNA, 23 bp, Homo sapiens
gacctcacttggatggatgccga

SEQ ID NO: 12807 - DNA, 25 bp, Homo sapiens
aagatgagtggataagtggagcagc

SEQ ID NO: 12808 - DNA, 25 bp, Homo sapiens
gatcggctatcctgatgacattgtt

SEQ ID NO: 12809 - DNA, 23 bp, Homo sapiens
gacctcacttggatggatgccga

SEQ ID NO: 12810 - DNA, 24 bp, Homo sapiens
ggagacctcgttgactggtggact

SEQ ID NO: 12811 - DNA, 25 bp, Homo sapiens
tggtcaagcatacagagcctatcag

SEQ ID NO: 12812 - DNA, 25 bp, Homo sapiens
gcacagtccaggcaatttcaggatt

SEQ ID NO: 12813 - DNA, 25 bp, Homo sapiens
tggtcaagcatacagagcctatcag

SEQ ID NO: 12814 - DNA, 25 bp, Homo sapiens
gcacagtccaggcaatttcaggatt

SEQ ID NO: 12815 - DNA, 25 bp, Homo sapiens
agaagcctttcactgccgcaagaat

SEQ ID NO: 12816 - DNA, 25 bp, Homo sapiens
gcacagtccaggcaatttcaggatt

SEQ ID NO: 12817 - DNA, 25 bp, Homo sapiens
agaagcctttcactgccgcaagaat

SEQ ID NO: 12818 - DNA, 24 bp, Homo sapiens
gctagacttgccaacaccacagaa

SEQ ID NO: 12819 - DNA, 25 bp, Homo sapiens
aggccagagtatgcggttaactcca

SEQ ID NO: 12820 - DNA, 25 bp, Homo sapiens
tggtcaagcatacagagcctatcag

SEQ ID NO: 12821 - DNA, 23 bp, Homo sapiens
aagatggagacctcgttgactgg

SEQ ID NO: 12822 - DNA, 24 bp, Homo sapiens
ggcatcggcatggtcataggacac

SEQ ID NO: 12823 - DNA, 24 bp, Homo sapiens
gtctctctacggacctccccctgc

SEQ ID NO: 12824 - DNA, 24 bp, Homo sapiens
agtctctctacggacctccccctg

SEQ ID NO: 12825 - DNA, 24 bp, Homo sapiens
cagtctctctacggacctccccct

SEQ ID NO: 12826 - DNA, 24 bp, Homo sapiens
gcctacccgcggcctgccggctcc

SEQ ID NO: 12827 - DNA, 24 bp, Homo sapiens
tgcctacccgcggcctgccggctc

SEQ ID NO: 12828 - DNA, 24 bp, Homo sapiens
atgcctacccgcggcctgccggct

SEQ ID NO: 12829 - DNA, 24 bp, Homo sapiens
agtgattctcctgccttagcctcc

SEQ ID NO: 12830 - DNA, 23 bp, Homo sapiens
ctcaccacaacctccgcctcccg

SEQ ID NO: 12831 - DNA, 24 bp, Homo sapiens
cacatcgtgaagctgccgctgtta

SEQ ID NO: 12832 - DNA, 24 bp, Homo sapiens
gtcaacaccttctcggccctcctc

SEQ ID NO: 12833 - DNA, 24 bp, Homo sapiens
gccatttcacactcaccctccacc

SEQ ID NO: 12834 - DNA, 24 bp, Homo sapiens
gtagaacagtggacagaaatggaa

SEQ ID NO: 12835 - DNA, 24 bp, Homo sapiens
tgtagaacagtggacagaaatgga

SEQ ID NO: 12836 - DNA, 24 bp, Homo sapiens
atgtagaacagtggacagaaatgg

SEQ ID NO: 12837 - DNA, 24 bp, Homo sapiens
accacgtcttgcatccttccttct

SEQ ID NO: 12838 - DNA, 24 bp, Homo sapiens
ggaggaagtaggctatgatacaca

SEQ ID NO: 12839 - DNA, 24 bp, Homo sapiens
ttgagtcttgatttggagaaaggt

SEQ ID NO: 12840 - DNA, 24 bp, Homo sapiens
ccacagacacagttctcctggatt

SEQ ID NO: 12841 - DNA, 24 bp, Homo sapiens
gcctgtttctggattctaagggta

SEQ ID NO: 12842 - DNA, 24 bp, Homo sapiens
aaactagtcagtccaagtatttct

SEQ ID NO: 12843 - DNA, 24 bp, Homo sapiens
acagtgcccagccctaatttgagt

SEQ ID NO: 12844 - DNA, 24 bp, Homo sapiens
ctattctcctgcctcagcccacct

SEQ ID NO: 12845 - DNA, 24 bp, Homo sapiens
gcctctcaaagtgctgggattata

SEQ ID NO: 12846 - DNA, 23 bp, Homo sapiens
ggctctgtggtctgtggaatgaa

SEQ ID NO: 12847 - DNA, 25 bp, Homo sapiens
ggaacagaatcaacccagaacggat

SEQ ID NO: 12848 - DNA, 25 bp, Homo sapiens
cctctgaatctttctgtttggctgc

SEQ ID NO: 12849 - DNA, 24 bp, Homo sapiens
caaacaaccttgacctcctgctca

SEQ ID NO: 12850 - DNA, 23 bp, Homo sapiens
acttcctcctggtgatgctcagc

SEQ ID NO: 12851 - DNA, 25 bp, Homo sapiens
accatcaccaatgagaacccatcgg

SEQ ID NO: 12852 - DNA, 24 bp, Homo sapiens
tagccaggctggtcttgaactcca

SEQ ID NO: 12853 - DNA, 24 bp, Homo sapiens
aagggatccgcctgcctcagcttt

SEQ ID NO: 12854 - DNA, 24 bp, Homo sapiens
ccaccctcagcggatgataatctc

SEQ ID NO: 12855 - DNA, 24 bp, Homo sapiens
tccaccctcagcggatgataatct

SEQ ID NO: 12856 - DNA, 24 bp, Homo sapiens
ttccaccctcagcggatgataatc

SEQ ID NO: 12857 - DNA, 24 bp, Homo sapiens
ataatctcaagacacctcctgagt

SEQ ID NO: 12858 - DNA, 24 bp, Homo sapiens
gataatctcaagacacctcctgag

SEQ ID NO: 12859 - DNA, 24 bp, Homo sapiens
tgataatctcaagacacctcctga

SEQ ID NO: 12860 - DNA, 24 bp, Homo sapiens
agagtgctgggattacaggcgtca

SEQ ID NO: 12861 - DNA, 24 bp, Homo sapiens
tctcctgacctcgtgatccatccg

SEQ ID NO: 12862 - DNA, 24 bp, Homo sapiens
cctctgcctcccaggttcaaatga

SEQ ID NO: 12863 - DNA, 24 bp, Homo sapiens
catccctgttggtaaccgtgttgc

SEQ ID NO: 12864 - DNA, 24 bp, Homo sapiens
ccatccctgttggtaaccgtgttg

SEQ ID NO: 12865 - DNA, 24 bp, Homo sapiens
cccatccctgttggtaaccgtgtt

SEQ ID NO: 12866 - DNA, 24 bp, Homo sapiens
ccaccctcagcggatgataatctc

SEQ ID NO: 12867 - DNA, 24 bp, Homo sapiens
ataatctcaagacacctcccgagt

SEQ ID NO: 12868 - DNA, 24 bp, Homo sapiens
gataatctcaagacacctcccgag

SEQ ID NO: 12869 - DNA, 24 bp, Homo sapiens
tgataatctcaagacacctcccga

SEQ ID NO: 12870 - DNA, 24 bp, Homo sapiens
tgataatctcaagacacctgccga

SEQ ID NO: 12871 - DNA, 24 bp, Homo sapiens
gagcctcaagacaccttccgagcg

SEQ ID NO: 12872 - DNA, 24 bp, Homo sapiens
gccacctcctccaactcaacaaca

SEQ ID NO: 12873 - DNA, 24 bp, Homo sapiens
agcaggcagtaagcaagaggagga

SEQ ID NO: 12874 - DNA, 24 bp, Homo sapiens
agatggagtctcgctgtgtcaccc

SEQ ID NO: 12875 - DNA, 24 bp, Homo sapiens
cctctgcctcccaggttcaaatga

SEQ ID NO: 12876 - DNA, 24 bp, Homo sapiens
gagcatcgtcattcttcaggattg

SEQ ID NO: 12877 - DNA, 24 bp, Homo sapiens
gccacctcctccaactcaacaaca

SEQ ID NO: 12878 - DNA, 24 bp, Homo sapiens
gagcctcaagacaccttccgagcg

SEQ ID NO: 12879 - DNA, 24 bp, Homo sapiens
ggttcttcctgccatcctgccatc

SEQ ID NO: 12880 - DNA, 24 bp, Homo sapiens
acaggttgatggacggatggctac

SEQ ID NO: 12881 - DNA, 24 bp, Homo sapiens
ggatatgaatggctgagcggaggc

SEQ ID NO: 12882 - DNA, 24 bp, Homo sapiens
taatctcaagacacctcccgagtg

SEQ ID NO: 12883 - DNA, 24 bp, Homo sapiens
ctccccttccaccctcagcggatg

SEQ ID NO: 12884 - DNA, 24 bp, Homo sapiens
tcaagaaactaatgaagaataaat

SEQ ID NO: 12885 - DNA, 24 bp, Homo sapiens
cacctcccgagtgtgtctgctcac

SEQ ID NO: 12886 - DNA, 24 bp, Homo sapiens
catgacgtgaggccgtggatgcag

SEQ ID NO: 12887 - DNA, 24 bp, Homo sapiens
gccctgactacaattggaaatgcc

SEQ ID NO: 12888 - DNA, 24 bp, Homo sapiens
gcagcagcatgtaaagtcagtgac

SEQ ID NO: 12889 - DNA, 24 bp, Homo sapiens
ccatgaccagggccagctcaccaa

SEQ ID NO: 12890 - DNA, 24 bp, Homo sapiens
aatctcaagacaccttccgagcgt

SEQ ID NO: 12891 - DNA, 24 bp, Homo sapiens
agcggatgataatctcaagacacg

SEQ ID NO: 12892 - DNA, 24 bp, Homo sapiens
ccaccctcagcggatgataaactc

SEQ ID NO: 12893 - DNA, 24 bp, Homo sapiens
acctcccgagtgtctgctcactcc

SEQ ID NO: 12894 - DNA, 24 bp, Homo sapiens
cacctcccgagtgtctgctcactc

SEQ ID NO: 12895 - DNA, 24 bp, Homo sapiens
acacctcccgagtgtctgctcact

SEQ ID NO: 12896 - DNA, 24 bp, Homo sapiens
ttccaccctcagcggatgataatc

SEQ ID NO: 12897 - DNA, 24 bp, Homo sapiens
acatcaagacacctgccttccacc

SEQ ID NO: 12898 - DNA, 24 bp, Homo sapiens
caccttccgagcgtcagctcactc

SEQ ID NO: 12899 - DNA, 24 bp, Homo sapiens
aaaccacgcaaacccaagaggcag

SEQ ID NO: 12900 - DNA, 24 bp, Homo sapiens
ggaaccgtcacgcaaacccaagag

SEQ ID NO: 12901 - DNA, 24 bp, Homo sapiens
agccgatgataatctcaagacacc

SEQ ID NO: 12902 - DNA, 24 bp, Homo sapiens
ctccaccctcagcagatgataata

SEQ ID NO: 12903 - DNA, 24 bp, Homo sapiens
gctccaccctcagcagatgataat

SEQ ID NO: 12904 - DNA, 24 bp, Homo sapiens
agctccaccctcagcagatgataa

SEQ ID NO: 12905 - DNA, 24 bp, Homo sapiens
ccgaacccaagaggcggagggtcg

SEQ ID NO: 12906 - DNA, 24 bp, Homo sapiens
cccgaacccaagaggcggagggtc

SEQ ID NO: 12907 - DNA, 24 bp, Homo sapiens
acccgaacccaagaggcggagggt

SEQ ID NO: 12908 - DNA, 24 bp, Homo sapiens
ctcaagacaccttccgagcgtcag

SEQ ID NO: 12909 - DNA, 24 bp, Homo sapiens
aatatcaagacacctgccgagcgt

SEQ ID NO: 12910 - DNA, 24 bp, Homo sapiens
gggccgcttccaccctcagcggat

SEQ ID NO: 12911 - DNA, 24 bp, Homo sapiens
tgacttgggctttggaagtagctg

SEQ ID NO: 12912 - DNA, 24 bp, Homo sapiens
ctgcagtgacagtgagacatggct

SEQ ID NO: 12913 - DNA, 24 bp, Homo sapiens
cctgcagtgacagtgagacatggc

SEQ ID NO: 12914 - DNA, 24 bp, Homo sapiens
gcctgcagtgacagtgagacatgg

SEQ ID NO: 12915 - DNA, 24 bp, Homo sapiens
agcattatgatggtggtagaagca

SEQ ID NO: 12916 - DNA, 24 bp, Homo sapiens
ctgaagctatacagggaattgctg

SEQ ID NO: 12917 - DNA, 24 bp, Homo sapiens
tgtccaaaccgactgactcttccc

SEQ ID NO: 12918 - DNA, 24 bp, Homo sapiens
tctccagctttgacaaatcggtgc

SEQ ID NO: 12919 - DNA, 24 bp, Homo sapiens
tgtgtgccatgacaggtgttgatt

SEQ ID NO: 12920 - DNA, 24 bp, Homo sapiens
ccagtgctgggtgtaagagtgcca

SEQ ID NO: 12921 - DNA, 24 bp, Homo sapiens
atgcccatgcgagtacctgaggaa

SEQ ID NO: 12922 - DNA, 24 bp, Homo sapiens
agcggatgataatctcaagacacc

SEQ ID NO: 12923 - DNA, 24 bp, Homo sapiens
gtcagctcactccccttccaccct

SEQ ID NO: 12924 - DNA, 24 bp, Homo sapiens
aagacacctgccgagcgtctgcgg

SEQ ID NO: 12925 - DNA, 24 bp, Homo sapiens
caagacacctgccgagcgtctgcg

SEQ ID NO: 12926 - DNA, 24 bp, Homo sapiens
tcaagacacctgccgagcgtctgc

SEQ ID NO: 12927 - DNA, 24 bp, Homo sapiens
atacctgctgagcgtctgcggatt

SEQ ID NO: 12928 - DNA, 24 bp, Homo sapiens
aatatcaagacacctgccgagcgt

SEQ ID NO: 12929 - DNA, 24 bp, Homo sapiens
aatatcaagacacctgccgagcgt

SEQ ID NO: 12930 - DNA, 24 bp, Homo sapiens
ccaccctcagcggatgataatctc

SEQ ID NO: 12931 - DNA, 24 bp, Homo sapiens
ctccaccctcagcagatgataaca

SEQ ID NO: 12932 - DNA, 24 bp, Homo sapiens
agcgtcagctcactccccttccac

SEQ ID NO: 12933 - DNA, 24 bp, Homo sapiens
ggatgactgatggtccttggaaga

SEQ ID NO: 12934 - DNA, 24 bp, Homo sapiens
ttcaaatgaaagctgcctccagaa

SEQ ID NO: 12935 - DNA, 24 bp, Homo sapiens
gcaacatcaaaatcttcaggcaca

SEQ ID NO: 12936 - DNA, 24 bp, Homo sapiens
aatctcaagacaccttccgagcgt

SEQ ID NO: 12937 - DNA, 25 bp, Homo sapiens
aatatcaagacacctgctgagcgtc

SEQ ID NO: 12938 - DNA, 24 bp, Homo sapiens
aatctcaagacaccttccgagcgt

SEQ ID NO: 12939 - DNA, 24 bp, Homo sapiens
tcaagacacctcccttagctactc

SEQ ID NO: 12940 - DNA, 24 bp, Homo sapiens
ctcaagacacctcccttagctact

SEQ ID NO: 12941 - DNA, 24 bp, Homo sapiens
tctcaagacacctcccttagctac

SEQ ID NO: 12942 - DNA, 24 bp, Homo sapiens
agcggatgataatctcaagacacc

SEQ ID NO: 12943 - DNA, 24 bp, Homo sapiens
tcagctcactccccttccaccctc

SEQ ID NO: 12944 - DNA, 24 bp, Homo sapiens
gatgataatatcaagacacctgcc

SEQ ID NO: 12945 - DNA, 24 bp, Homo sapiens
gcggatgataatctcaagacacct

SEQ ID NO: 12946 - DNA, 24 bp, Homo sapiens
tcagctcactccccttccaccctc

SEQ ID NO: 12947 - DNA, 24 bp, Homo sapiens
accctcagcagatgataatatcaa

SEQ ID NO: 12948 - DNA, 24 bp, Homo sapiens
acgcctctacttggtcagtttcta

SEQ ID NO: 12949 - DNA, 24 bp, Homo sapiens
gccattttgggtagctgatcttgc

SEQ ID NO: 12950 - DNA, 24 bp, Homo sapiens
cctcctccatcagtgtcattacca

SEQ ID NO: 12951 - DNA, 24 bp, Homo sapiens
agtaatgagatgtgtgacggctgc

SEQ ID NO: 12952 - DNA, 24 bp, Homo sapiens
gctgctaatgagcgtgttggtgtt

SEQ ID NO: 12953 - DNA, 24 bp, Homo sapiens
gctgctaatgagcgtgttggtgtt

SEQ ID NO: 12954 - DNA, 24 bp, Homo sapiens
ggattagaccaactggagaattgc

SEQ ID NO: 12955 - DNA, 24 bp, Homo sapiens
tgtgacggctgcaaaccaggtgtt

SEQ ID NO: 12956 - DNA, 24 bp, Homo sapiens
tgctctatcctcttccttgccaga

SEQ ID NO: 12957 - DNA, 24 bp, Homo sapiens
gagatgtgttgatgtttgccgtgt

SEQ ID NO: 12958 - DNA, 24 bp, Homo sapiens
gcaccgtggaacttgtattcgaca

SEQ ID NO: 12959 - DNA, 24 bp, Homo sapiens
gcaccgtggaacttgtattcgaca

SEQ ID NO: 12960 - DNA, 24 bp, Homo sapiens
accagtcaacaattccacgcaatc

SEQ ID NO: 12961 - DNA, 24 bp, Homo sapiens
gctcaagacaccttccagacaatt

SEQ ID NO: 12962 - DNA, 24 bp, Homo sapiens
accagtcaacaattccacgcaatc

SEQ ID NO: 12963 - DNA, 24 bp, Homo sapiens
ggaagctgcacaattcactgttct

SEQ ID NO: 12964 - DNA, 24 bp, Homo sapiens
agatgctatcctttggcagtgggc

SEQ ID NO: 12965 - DNA, 24 bp, Homo sapiens
tgctaatgccttaacttcacctcc

SEQ ID NO: 12966 - DNA, 24 bp, Homo sapiens
aaacttgtcaggactggctaacgc

SEQ ID NO: 12967 - DNA, 24 bp, Homo sapiens
atgagggtaggattgttggcaggc

SEQ ID NO: 12968 - DNA, 24 bp, Homo sapiens
ggaattgctgtctggtcatcatct

SEQ ID NO: 12969 - DNA, 24 bp, Homo sapiens
agcattatgatggtggtagaagca

SEQ ID NO: 12970 - DNA, 24 bp, Homo sapiens
atgagggtaggattgttggcaggc

SEQ ID NO: 12971 - DNA, 24 bp, Homo sapiens
tgctacatctcaactgccgattgg

SEQ ID NO: 12972 - DNA, 24 bp, Homo sapiens
gcaggaatggcagaacgctatcca

SEQ ID NO: 12973 - DNA, 24 bp, Homo sapiens
accagtagcacttccctcaacctg

SEQ ID NO: 12974 - DNA, 24 bp, Homo sapiens
gcagcagcatgtaaagtcagtgac

SEQ ID NO: 12975 - DNA, 24 bp, Homo sapiens
tctctattgtcctgaccccacagt

SEQ ID NO: 12976 - DNA, 24 bp, Homo sapiens
ccatgaccagggccagctcaccaa

SEQ ID NO: 12977 - DNA, 24 bp, Homo sapiens
aatatcaagacacctgccgagcgt

SEQ ID NO: 12978 - DNA, 24 bp, Homo sapiens
acatcaagacacctgccttccacc

SEQ ID NO: 12979 - DNA, 24 bp, Homo sapiens
atacctgctgagcgtctgcggatt

SEQ ID NO: 12980 - DNA, 24 bp, Homo sapiens
aatctcaagacaccttccgagcgt

SEQ ID NO: 12981 - DNA, 24 bp, Homo sapiens
cttccaccctcagctccaccctca

SEQ ID NO: 12982 - DNA, 24 bp, Homo sapiens
cgggggccgcttccaccctcagcg

SEQ ID NO: 12983 - DNA, 24 bp, Homo sapiens
tcctcctacctgagcctcctgagt

SEQ ID NO: 12984 - DNA, 24 bp, Homo sapiens
caaggctggagtgtagtagtgcta

SEQ ID NO: 12985 - DNA, 24 bp, Homo sapiens
atcctcccatctcaacctcccacg

SEQ ID NO: 12986 - DNA, 24 bp, Homo sapiens
gcttaacacgcccactgattctac

SEQ ID NO: 12987 - DNA, 24 bp, Homo sapiens
gcagtctccgcagatgaggctact

SEQ ID NO: 12988 - DNA, 24 bp, Homo sapiens
ccacaggcacagctccatcgttac

SEQ ID NO: 12989 - DNA, 24 bp, Homo sapiens
gcagtctccgcagatgaggctact

SEQ ID NO: 12990 - DNA, 24 bp, Homo sapiens
ccacaggcacagctccatcgttac

SEQ ID NO: 12991 - DNA, 24 bp, Homo sapiens
tcctgcctcccagccttctctcta

SEQ ID NO: 12992 - DNA, 23 bp, Homo sapiens
ctggagtgcaatggtggcgatct

SEQ ID NO: 12993 - DNA, 23 bp, Homo sapiens
gctgcaacctccgcttcctgggt

SEQ ID NO: 12994 - DNA, 23 bp, Homo sapiens
catttgaacccgggaggcagagg

SEQ ID NO: 12995 - DNA, 23 bp, Homo sapiens
gagctgagatcgcgccactgcac

SEQ ID NO: 12996 - DNA, 23 bp, Homo sapiens
ccggcgacagagcgagaatctgt

SEQ ID NO: 12997 - DNA, 24 bp, Homo sapiens
ctagcaatcagcgagactccgtgg

SEQ ID NO: 12998 - DNA, 24 bp, Homo sapiens
gttcagaattgccaggactgtgga

SEQ ID NO: 12999 - DNA, 24 bp, Homo sapiens
tacctaagcaagcctgggcaatgg

SEQ ID NO: 13000 - DNA, 24 bp, Homo sapiens
acctcctgacctcgtgatccaccc

SEQ ID NO: 13001 - DNA, 24 bp, Homo sapiens
gacctcctgacctcgtgatccacc

SEQ ID NO: 13002 - DNA, 24 bp, Homo sapiens
cgacctcctgacctcgtgatccac

SEQ ID NO: 13003 - DNA, 24 bp, Homo sapiens
tgcctccccaggtcaccatcctct

SEQ ID NO: 13004 - DNA, 24 bp, Homo sapiens
ttgcctccccaggtcaccatcctc

SEQ ID NO: 13005 - DNA, 24 bp, Homo sapiens
tttgcctccccaggtcaccatcct

SEQ ID NO: 13006 - DNA, 24 bp, Homo sapiens
cggcaagatggcagaagtagagca

SEQ ID NO: 13007 - DNA, 24 bp, Homo sapiens
tccacaacggcaagaccttcaacc

SEQ ID NO: 13008 - DNA, 24 bp, Homo sapiens
gaccttccgcaagttcacctaccg

SEQ ID NO: 13009 - DNA, 24 bp, Homo sapiens
tgcctgctaacacaacatccattc

SEQ ID NO: 13010 - DNA, 24 bp, Homo sapiens
agcgattctcatgccttagcctcc

SEQ ID NO: 13011 - DNA, 24 bp, Homo sapiens
tgatctcggctcaccataacctcc

SEQ ID NO: 13012 - DNA, 24 bp, Homo sapiens
agccttgaagttcctgccttggtc

SEQ ID NO: 13013 - DNA, 24 bp, Homo sapiens
acaatgtggtagaagtgatggtgc

SEQ ID NO: 13014 - DNA, 24 bp, Homo sapiens
gtgccacttgtcccgttgaactgt

SEQ ID NO: 13015 - DNA, 24 bp, Homo sapiens
acgctccctcctcagtgtcaccat

SEQ ID NO: 13016 - DNA, 24 bp, Homo sapiens
cttctgccacgctccctcctcaat

SEQ ID NO: 13017 - DNA, 24 bp, Homo sapiens
acgctccctcctcagtgtcaccat

SEQ ID NO: 13018 - DNA, 24 bp, Homo sapiens
gcctcacagcagattcttcacgcc

SEQ ID NO: 13019 - DNA, 24 bp, Homo sapiens
tgtctcactgtggcatcctcaggc

SEQ ID NO: 13020 - DNA, 24 bp, Homo sapiens
ctcccgtcggcctctacaatccca

SEQ ID NO: 13021 - DNA, 24 bp, Homo sapiens
ccagtcagcctctacagaccaagc

SEQ ID NO: 13022 - DNA, 24 bp, Homo sapiens
gcagtctccgcagatgagcctact

SEQ ID NO: 13023 - DNA, 24 bp, Homo sapiens
ccacaggcacagctccatcgttac

SEQ ID NO: 13024 - DNA, 24 bp, Homo sapiens
gcgaccacctctgccgacactata

SEQ ID NO: 13025 - DNA, 24 bp, Homo sapiens
caggcaggtcttgaactcttggct

SEQ ID NO: 13026 - DNA, 24 bp, Homo sapiens
ttcaagtgatcttccagcctcggc

SEQ ID NO: 13027 - DNA, 24 bp, Homo sapiens
ccaggctggagtacagtggtgcga

SEQ ID NO: 13028 - DNA, 24 bp, Homo sapiens
ctccctgcaacttctgcctcccag

SEQ ID NO: 13029 - DNA, 24 bp, Homo sapiens
gcgattttcctgcctcagcttcct

SEQ ID NO: 13030 - DNA, 24 bp, Homo sapiens
caccagaagctgagcagatgccag

SEQ ID NO: 13031 - DNA, 24 bp, Homo sapiens
acaatggcatgatctcggctcacc

SEQ ID NO: 13032 - DNA, 24 bp, Homo sapiens
ggttcaagcgattctcctgcctca

SEQ ID NO: 13033 - DNA, 24 bp, Homo sapiens
ccaagtggctgggattacaggcat

SEQ ID NO: 13034 - DNA, 24 bp, Homo sapiens
cgccatggcaggtgcagatctttg

SEQ ID NO: 13035 - DNA, 24 bp, Homo sapiens
ccgccatggcaggtgcagatcttt

SEQ ID NO: 13036 - DNA, 24 bp, Homo sapiens
accgccatggcaggtgcagatctt

SEQ ID NO: 13037 - DNA, 24 bp, Homo sapiens
ccttgtaacagaaactggcgatgg

SEQ ID NO: 13038 - DNA, 24 bp, Homo sapiens
gccttgtaacagaaactggcgatg

SEQ ID NO: 13039 - DNA, 24 bp, Homo sapiens
tgccttgtaacagaaactggcgat

SEQ ID NO: 13040 - DNA, 24 bp, Homo sapiens
ggaagagggagtcaccactggacc

SEQ ID NO: 13041 - DNA, 24 bp, Homo sapiens
ttgattgaaccaggatgaatgcgg

SEQ ID NO: 13042 - DNA, 24 bp, Homo sapiens
tgatcttggcttgattcagtctgc

SEQ ID NO: 13043 - DNA, 24 bp, Homo sapiens
acaggtattgtgcctcgtgattgg

SEQ ID NO: 13044 - DNA, 24 bp, Homo sapiens
gctgtgcccacttcaagaatgtca

SEQ ID NO: 13045 - DNA, 24 bp, Homo sapiens
gcagttggtttctgtgggcaaagc

SEQ ID NO: 13046 - DNA, 24 bp, Homo sapiens
tgatcttggcttgattcagtctgc

SEQ ID NO: 13047 - DNA, 24 bp, Homo sapiens
ctggcgatggaatatgagaggagc

SEQ ID NO: 13048 - DNA, 24 bp, Homo sapiens
gctgtgcccacttcaagaatgtca

SEQ ID NO: 13049 - DNA, 24 bp, Homo sapiens
taacagaccacctgcaccaacagc

SEQ ID NO: 13050 - DNA, 24 bp, Homo sapiens
acagcctccagttacgaagcctct

SEQ ID NO: 13051 - DNA, 24 bp, Homo sapiens
gttctctgcttatacacagtctgc

SEQ ID NO: 13052 - DNA, 24 bp, Homo sapiens
gtgccagggccgttaagagtggac

SEQ ID NO: 13053 - DNA, 24 bp, Homo sapiens
ggtgccagggccgttaagagtgga

SEQ ID NO: 13054 - DNA, 24 bp, Homo sapiens
ggtgccagggccgttaagagtgga

SEQ ID NO: 13055 - DNA, 24 bp, Homo sapiens
aattaaccgtgcccagcctgttca

SEQ ID NO: 13056 - DNA, 24 bp, Homo sapiens
aaattaaccgtgcccagcctgttc

SEQ ID NO: 13057 - DNA, 24 bp, Homo sapiens
aaaattaaccgtgcccagcctgtt

SEQ ID NO: 13058 - DNA, 24 bp, Homo sapiens
caggctgggcttcctgacaagctt

SEQ ID NO: 13059 - DNA, 24 bp, Homo sapiens
aaggccagccatgcctcccacaca

SEQ ID NO: 13060 - DNA, 24 bp, Homo sapiens
tgacccgccctcctcggcctccca

SEQ ID NO: 13061 - DNA, 24 bp, Homo sapiens
gtgacccgccctcctcggcctccc

SEQ ID NO: 13062 - DNA, 24 bp, Homo sapiens
cgtgacccgccctcctcggcctcc

SEQ ID NO: 13063 - DNA, 24 bp, Homo sapiens
gcgacgctgcggtgagcactagtg

SEQ ID NO: 13064 - DNA, 24 bp, Homo sapiens
tgcgacgctgcggtgagcactagt

SEQ ID NO: 13065 - DNA, 24 bp, Homo sapiens
ctgcgacgctgcggtgagcactag

SEQ ID NO: 13066 - DNA, 24 bp, Homo sapiens
ttcctccccaggctgctgctcctg

SEQ ID NO: 13067 - DNA, 24 bp, Homo sapiens
tttcctccccaggctgctgctcct

SEQ ID NO: 13068 - DNA, 24 bp, Homo sapiens
ctttcctccccaggctgctgctcc

SEQ ID NO: 13069 - DNA, 24 bp, Homo sapiens
gtggaggtagtggtgagccgagat

SEQ ID NO: 13070 - DNA, 23 bp, Homo sapiens
gaggcaggagaatcacttgaacc

SEQ ID NO: 13071 - DNA, 24 bp, Homo sapiens
ctgggcaacaaaagcgaaactccg

SEQ ID NO: 13072 - DNA, 24 bp, Homo sapiens
aggccgagcaggaggagtatgtgc

SEQ ID NO: 13073 - DNA, 24 bp, Homo sapiens
aaggccgagcaggaggagtatgtg

SEQ ID NO: 13074 - DNA, 24 bp, Homo sapiens
gaaggccgagcaggaggagtatgt

SEQ ID NO: 13075 - DNA, 24 bp, Homo sapiens
cagatgccctacttcaccgaccgt

SEQ ID NO: 13076 - DNA, 24 bp, Homo sapiens
catcggctctgtgctcatctctgt

SEQ ID NO: 13077 - DNA, 24 bp, Homo sapiens
ccagatcaccgaagacgccattgc

SEQ ID NO: 13078 - DNA, 24 bp, Homo sapiens
cacatctacgccctcacggacaac

SEQ ID NO: 13079 - DNA, 24 bp, Homo sapiens
catcggctctgtgctcatctctgt

SEQ ID NO: 13080 - DNA, 24 bp, Homo sapiens
ccagatcaccgaagacgccattgc

SEQ ID NO: 13081 - DNA, 24 bp, Homo sapiens
ttcggcaacgccaagactgtgcgc

SEQ ID NO: 13082 - DNA, 24 bp, Homo sapiens
ctgcagtccaacccgctgctcgag

SEQ ID NO: 13083 - DNA, 24 bp, Homo sapiens
aggagagggatttgtcatcagcgt

SEQ ID NO: 13084 - DNA, 24 bp, Homo sapiens
tggtgactatgatgaaacgccttc

SEQ ID NO: 13085 - DNA, 24 bp, Homo sapiens
atagttggaggatgctgtgggtca

SEQ ID NO: 13086 - DNA, 24 bp, Homo sapiens
attcctccaccgacaacgctcaag

SEQ ID NO: 13087 - DNA, 24 bp, Homo sapiens
tgaccaccagcgggaccagccaag

SEQ ID NO: 13088 - DNA, 24 bp, Homo sapiens
ttcacacacttcctccacacacca

SEQ ID NO: 13089 - DNA, 24 bp, Homo sapiens
aattccttccagcaacagccaccg

SEQ ID NO: 13090 - DNA, 24 bp, Homo sapiens
gccaccacaaatgatgtttcctcc

SEQ ID NO: 13091 - DNA, 24 bp, Homo sapiens
ttgaacaatcagccaccaccagga

SEQ ID NO: 13092 - DNA, 24 bp, Homo sapiens
tcagttcagaatggagcagatggt

SEQ ID NO: 13093 - DNA, 24 bp, Homo sapiens
cacctgaatgcctacttcttggaa

SEQ ID NO: 13094 - DNA, 24 bp, Homo sapiens
tgctccgagagaatggtgactcct

SEQ ID NO: 13095 - DNA, 24 bp, Homo sapiens
ggttcaagcgattctcctgcctca

SEQ ID NO: 13096 - DNA, 24 bp, Homo sapiens
ttggtcaggctggtcttgaactcc

SEQ ID NO: 13097 - DNA, 24 bp, Homo sapiens
cccaaagtgctaggattacaggcg

SEQ ID NO: 13098 - DNA, 24 bp, Homo sapiens
atctcttccagcctcagccgcaca

SEQ ID NO: 13099 - DNA, 24 bp, Homo sapiens
catctcttccagcctcagccgcac

SEQ ID NO: 13100 - DNA, 24 bp, Homo sapiens
gcatctcttccagcctcagccgca

SEQ ID NO: 13101 - DNA, 24 bp, Homo sapiens
ccccgctccagcagcctcccgcga

SEQ ID NO: 13102 - DNA, 24 bp, Homo sapiens
gccccgctccagcagcctcccgcg

SEQ ID NO: 13103 - DNA, 24 bp, Homo sapiens
tgccccgctccagcagcctcccgc

SEQ ID NO: 13104 - DNA, 24 bp, Homo sapiens
atcgaaaagaggtgccgccggatg

SEQ ID NO: 13105 - DNA, 24 bp, Homo sapiens
catcgaaaagaggtgccgccggat

SEQ ID NO: 13106 - DNA, 24 bp, Homo sapiens
tcatcgaaaagaggtgccgccgga

SEQ ID NO: 13107 - DNA, 24 bp, Homo sapiens
cctctctccaggtgcccatcagaa

SEQ ID NO: 13108 - DNA, 24 bp, Homo sapiens
gcctctctccaggtgcccatcaga

SEQ ID NO: 13109 - DNA, 24 bp, Homo sapiens
agcctctctccaggtgcccatcag

SEQ ID NO: 13110 - DNA, 24 bp, Homo sapiens
ggttgtctctgatgattacctgca

SEQ ID NO: 13111 - DNA, 24 bp, Homo sapiens
aatttgcactcagcctctctccag

SEQ ID NO: 13112 - DNA, 24 bp, Homo sapiens
ggttgtctctgatgattacctgca

SEQ ID NO: 13113 - DNA, 24 bp, Homo sapiens
caaggaatgtgacttccagaccaa

SEQ ID NO: 13114 - DNA, 24 bp, Homo sapiens
cctctctccaggtgcccatcagaa

SEQ ID NO: 13115 - DNA, 24 bp, Homo sapiens
gcctctctccaggtgcccatcaga

SEQ ID NO: 13116 - DNA, 24 bp, Homo sapiens
agcctctctccaggtgcccatcag

SEQ ID NO: 13117 - DNA, 24 bp, Homo sapiens
ggctcatctacacctattcaggcc

SEQ ID NO: 13118 - DNA, 24 bp, Homo sapiens
gggctcatctacacctattcaggc

SEQ ID NO: 13119 - DNA, 24 bp, Homo sapiens
agggctcatctacacctattcagg

SEQ ID NO: 13120 - DNA, 24 bp, Homo sapiens
ccaagctgcaggtggagctggaca

SEQ ID NO: 13121 - DNA, 24 bp, Homo sapiens
accaagctgcaggtggagctggac

SEQ ID NO: 13122 - DNA, 24 bp, Homo sapiens
caccaagctgcaggtggagctgga

SEQ ID NO: 13123 - DNA, 24 bp, Homo sapiens
tccatgcccaggtggccgacatga

SEQ ID NO: 13124 - DNA, 24 bp, Homo sapiens
ctccatgcccaggtggccgacatg

SEQ ID NO: 13125 - DNA, 24 bp, Homo sapiens
cctccatgcccaggtggccgacat

SEQ ID NO: 13126 - DNA, 24 bp, Homo sapiens
ctggaggaggagctggaggaggag

SEQ ID NO: 13127 - DNA, 24 bp, Homo sapiens
ttagaggagaagcggcgtctggag

SEQ ID NO: 13128 - DNA, 24 bp, Homo sapiens
ggatgagctggctgacgagatcgc

SEQ ID NO: 13129 - DNA, 24 bp, Homo sapiens
aggtgaaggtgaacaaggatgaca

SEQ ID NO: 13130 - DNA, 24 bp, Homo sapiens
tggtatgggtgccttccgacaaga

SEQ ID NO: 13131 - DNA, 24 bp, Homo sapiens
caaggtggaggacatggcagagct

SEQ ID NO: 13132 - DNA, 24 bp, Homo sapiens
tctatgccatcacagacaccgcct

SEQ ID NO: 13133 - DNA, 24 bp, Homo sapiens
gcacaacctcaaggagcgttacta

SEQ ID NO: 13134 - DNA, 24 bp, Homo sapiens
caaggtggaggacatggcagagct

SEQ ID NO: 13135 - DNA, 24 bp, Homo sapiens
ggtcaagttcaacgagggagagcg

SEQ ID NO: 13136 - DNA, 24 bp, Homo sapiens
aagcagactctggagaacgagcgg

SEQ ID NO: 13137 - DNA, 24 bp, Homo sapiens
ggactcggagcacaagcgcaagaa

SEQ ID NO: 13138 - DNA, 24 bp, Homo sapiens
ggatgagctggctgacgagatcgc

SEQ ID NO: 13139 - DNA, 23 bp, Homo sapiens
caaggaaggaaatggcaccgtca

SEQ ID NO: 13140 - DNA, 23 bp, Homo sapiens
ccaagaacaaggaccagggcacc

SEQ ID NO: 13141 - DNA, 24 bp, Homo sapiens
tccggcatgttcttgtcacactgg

SEQ ID NO: 13142 - DNA, 24 bp, Homo sapiens
tggagctgcaggtgtcctccctgg

SEQ ID NO: 13143 - DNA, 24 bp, Homo sapiens
ctggagctgcaggtgtcctccctg

SEQ ID NO: 13144 - DNA, 24 bp, Homo sapiens
gctggagctgcaggtgtcctccct

SEQ ID NO: 13145 - DNA, 24 bp, Homo sapiens
acacgttccaggatttcaccgagc

SEQ ID NO: 13146 - DNA, 24 bp, Homo sapiens
tacacgttccaggatttcaccgag

SEQ ID NO: 13147 - DNA, 24 bp, Homo sapiens
gtacacgttccaggatttcaccga

SEQ ID NO: 13148 - DNA, 24 bp, Homo sapiens
actaccagatcgtcgtcagcaacc

SEQ ID NO: 13149 - DNA, 24 bp, Homo sapiens
cctcaacctcttccagtcactgct

SEQ ID NO: 13150 - DNA, 24 bp, Homo sapiens
gttcacccgtggctacaccaagaa

SEQ ID NO: 13151 - DNA, 24 bp, Homo sapiens
tgcaggtgtgcaccaccatgccca

SEQ ID NO: 13152 - DNA, 24 bp, Homo sapiens
ctgcaggtgtgcaccaccatgccc

SEQ ID NO: 13153 - DNA, 24 bp, Homo sapiens
actgcaggtgtgcaccaccatgcc

SEQ ID NO: 13154 - DNA, 24 bp, Homo sapiens
ggccctaagggtgaaggagaacga

SEQ ID NO: 13155 - DNA, 24 bp, Homo sapiens
gggccctaagggtgaaggagaacg

SEQ ID NO: 13156 - DNA, 24 bp, Homo sapiens
cgggccctaagggtgaaggagaac

SEQ ID NO: 13157 - DNA, 24 bp, Homo sapiens
aacaagcatagtctgagcggaaga

SEQ ID NO: 13158 - DNA, 25 bp, Homo sapiens
agaagatcctgatggtgaacatgcc

SEQ ID NO: 13159 - DNA, 23 bp, Homo sapiens
aaggtgatggctacgactggtgg

SEQ ID NO: 13160 - DNA, 25 bp, Homo sapiens
aaaggagatttcttccctcctgagc

SEQ ID NO: 13161 - DNA, 24 bp, Homo sapiens
aagctactctggtggagagttcta

SEQ ID NO: 13162 - DNA, 24 bp, Homo sapiens
aaagctactctggtggagagttct

SEQ ID NO: 13163 - DNA, 24 bp, Homo sapiens
gaaagctactctggtggagagttc

SEQ ID NO: 13164 - DNA, 24 bp, Homo sapiens
atttttaaaaggcaagaaacaaaa

SEQ ID NO: 13165 - DNA, 24 bp, Homo sapiens
catttttaaaaggcaagaaacaaa

SEQ ID NO: 13166 - DNA, 24 bp, Homo sapiens
tcatttttaaaaggcaagaaacaa

SEQ ID NO: 13167 - DNA, 25 bp, Homo sapiens
ctgtcactgaagatgggttgcattt

SEQ ID NO: 13168 - DNA, 24 bp, Homo sapiens
aactattgggtttaggacagaaac

SEQ ID NO: 13169 - DNA, 24 bp, Homo sapiens
aaactattgggtttaggacagaaa

SEQ ID NO: 13170 - DNA, 24 bp, Homo sapiens
gaaactattgggtttaggacagaa

SEQ ID NO: 13171 - DNA, 24 bp, Homo sapiens
accatccacagatgattgctgtac

SEQ ID NO: 13172 - DNA, 24 bp, Homo sapiens
aaccatccacagatgattgctgta

SEQ ID NO: 13173 - DNA, 24 bp, Homo sapiens
gaaccatccacagatgattgctgt

SEQ ID NO: 13174 - DNA, 24 bp, Homo sapiens
aggaagacttgtgctgcacagtta

SEQ ID NO: 13175 - DNA, 24 bp, Homo sapiens
aaggaagacttgtgctgcacagtt

SEQ ID NO: 13176 - DNA, 24 bp, Homo sapiens
aaaggaagacttgtgctgcacagt

SEQ ID NO: 13177 - DNA, 24 bp, Homo sapiens
acaacactcctcattgaactgtgc

SEQ ID NO: 13178 - DNA, 24 bp, Homo sapiens
tcaacttccagcaccccctcacat

SEQ ID NO: 13179 - DNA, 24 bp, Homo sapiens
gtttgaggtctggaggaaccatcc

SEQ ID NO: 13180 - DNA, 24 bp, Homo sapiens
aatagttgattgtgctgccgtagc

SEQ ID NO: 13181 - DNA, 24 bp, Homo sapiens
acggcgaagtgatgatgacgacag

SEQ ID NO: 13182 - DNA, 24 bp, Homo sapiens
atcagtcttcagccgctaagccga

SEQ ID NO: 13183 - DNA, 24 bp, Homo sapiens
caatggcacgatcctggctcactg

SEQ ID NO: 13184 - DNA, 24 bp, Homo sapiens
tgggaaggagtcagtcagagagcc

SEQ ID NO: 13185 - DNA, 24 bp, Homo sapiens
gtcctccttaggttttcgtcatcg

SEQ ID NO: 13186 - DNA, 24 bp, Homo sapiens
tgtcctccttaggttttcgtcatc

SEQ ID NO: 13187 - DNA, 24 bp, Homo sapiens
ctgtcctccttaggttttcgtcat

SEQ ID NO: 13188 - DNA, 24 bp, Homo sapiens
tccagcctgatgcctccttactcc

SEQ ID NO: 13189 - DNA, 23 bp, Homo sapiens
cctgtccagccttcctgccatcc

SEQ ID NO: 13190 - DNA, 25 bp, Homo sapiens
tgagccacaatgctgtaacaagcca

SEQ ID NO: 13191 - DNA, 24 bp, Homo sapiens
aggctttggagggcgaggaggctt

SEQ ID NO: 13192 - DNA, 24 bp, Homo sapiens
gaggctttggagggcgaggaggct

SEQ ID NO: 13193 - DNA, 24 bp, Homo sapiens
ggaggctttggagggcgaggaggc

SEQ ID NO: 13194 - DNA, 24 bp, Homo sapiens
cagtaagaaagagcgagatgcgag

SEQ ID NO: 13195 - DNA, 24 bp, Homo sapiens
acagtaagaaagagcgagatgcga

SEQ ID NO: 13196 - DNA, 24 bp, Homo sapiens
gacagtaagaaagagcgagatgcg

SEQ ID NO: 13197 - DNA, 24 bp, Homo sapiens
gccgaggaggatttggtggcagag

SEQ ID NO: 13198 - DNA, 24 bp, Homo sapiens
cggctttggaggacgaggtggtgg

SEQ ID NO: 13199 - DNA, 24 bp, Homo sapiens
gcggctttggaggacgaggtggtg

SEQ ID NO: 13200 - DNA, 24 bp, Homo sapiens
ggcggctttggaggacgaggtggt

SEQ ID NO: 13201 - DNA, 24 bp, Homo sapiens
taagacagaagctgatgcagagaa

SEQ ID NO: 13202 - DNA, 24 bp, Homo sapiens
tgaagaaaagcagggaacagagat

SEQ ID NO: 13203 - DNA, 24 bp, Homo sapiens
tttccctgtactatactggagaga

SEQ ID NO: 13204 - DNA, 24 bp, Homo sapiens
cagcaacacctgccaagaagacag

SEQ ID NO: 13205 - DNA, 24 bp, Homo sapiens
aagcagctgtcactccaggcaaaa

SEQ ID NO: 13206 - DNA, 24 bp, Homo sapiens
cagttgccacaccagccaagaaag

SEQ ID NO: 13207 - DNA, 24 bp, Homo sapiens
agcaaagaaggtggtcgtttcccc

SEQ ID NO: 13208 - DNA, 24 bp, Homo sapiens
cataatccgcctgcctcggcctcc

SEQ ID NO: 13209 - DNA, 24 bp, Homo sapiens
ttggccagtctggtctcgaactcc

SEQ ID NO: 13210 - DNA, 24 bp, Homo sapiens
ccgaaagcagtgtgtggaccacta

SEQ ID NO: 13211 - DNA, 24 bp, Homo sapiens
tccgaaagcagtgtgtggaccact

SEQ ID NO: 13212 - DNA, 24 bp, Homo sapiens
atccgaaagcagtgtgtggaccac

SEQ ID NO: 13213 - DNA, 24 bp, Homo sapiens
cgctcttggtttgaatctggtcgc

SEQ ID NO: 13214 - DNA, 24 bp, Homo sapiens
agggactgcaaaagctctcaggga

SEQ ID NO: 13215 - DNA, 24 bp, Homo sapiens
aaaccggccttgtggaatttgcaa

SEQ ID NO: 13216 - DNA, 24 bp, Homo sapiens
tgcccttgcagattgatcacttat

SEQ ID NO: 13217 - DNA, 24 bp, Homo sapiens
gtgcccttgcagattgatcactta

SEQ ID NO: 13218 - DNA, 24 bp, Homo sapiens
tgtgcccttgcagattgatcactt

SEQ ID NO: 13219 - DNA, 24 bp, Homo sapiens
tgggaaaacaggtatggcttcaat

SEQ ID NO: 13220 - DNA, 24 bp, Homo sapiens
ttgggaaaacaggtatggcttcaa

SEQ ID NO: 13221 - DNA, 24 bp, Homo sapiens
attgggaaaacaggtatggcttca

SEQ ID NO: 13222 - DNA, 25 bp, Homo sapiens
ggatgctgttctcagactgacggat

SEQ ID NO: 13223 - DNA, 25 bp, Homo sapiens
caggctctatctgaaaccttcacaa

SEQ ID NO: 13224 - DNA, 25 bp, Homo sapiens
agtggctagaataattcatgctgtt

SEQ ID NO: 13225 - DNA, 23 bp, Homo sapiens
gctcagtcttgtgctgctcactt

SEQ ID NO: 13226 - DNA, 25 bp, Homo sapiens
tgaagaaggaagccagagtacaact

SEQ ID NO: 13227 - DNA, 25 bp, Homo sapiens
aatgatgctttctggctggatttaa

SEQ ID NO: 13228 - DNA, 25 bp, Homo sapiens
gtgctcagtgttggtggacaagtga

SEQ ID NO: 13229 - DNA, 25 bp, Homo sapiens
acaagagaaactgaaaggagtggaa

SEQ ID NO: 13230 - DNA, 24 bp, Homo sapiens
ttacagcagaggccggaagatgaa

SEQ ID NO: 13231 - DNA, 25 bp, Homo sapiens
ttcctcaagactttggctgtcaact

SEQ ID NO: 13232 - DNA, 25 bp, Homo sapiens
tccaaggctattcagtgtgcgagac

SEQ ID NO: 13233 - DNA, 25 bp, Homo sapiens
aggatgctgttctcagactgacgga

SEQ ID NO: 13234 - DNA, 24 bp, Homo sapiens
ctgaccaccagtatagttccagga

SEQ ID NO: 13235 - DNA, 25 bp, Homo sapiens
aagtgcctccaattcttcacagtaa

SEQ ID NO: 13236 - DNA, 24 bp, Homo sapiens
aagcgtgccagaatgtgaacacca

SEQ ID NO: 13237 - DNA, 25 bp, Homo sapiens
aacacaagggatgctcaaggacagt

SEQ ID NO: 13238 - DNA, 25 bp, Homo sapiens
tgtgttctttgtatcgtcgtgacca

SEQ ID NO: 13239 - DNA, 25 bp, Homo sapiens
gaacctaccaaatccctccacctgc

SEQ ID NO: 13240 - DNA, 25 bp, Homo sapiens
ttgatgaggtgaagtccattgctaa

SEQ ID NO: 13241 - DNA, 24 bp, Homo sapiens
tgggatggcacagcaaagagagac

SEQ ID NO: 13242 - DNA, 25 bp, Homo sapiens
gattgtggtggagttattgatgacg

SEQ ID NO: 13243 - DNA, 25 bp, Homo sapiens
caatgcttgctgttgtggactacat

SEQ ID NO: 13244 - DNA, 23 bp, Homo sapiens
gctcagtcttgtgctgctcactt

SEQ ID NO: 13245 - DNA, 25 bp, Homo sapiens
tgaagaaggaagccagagtacaact

SEQ ID NO: 13246 - DNA, 24 bp, Homo sapiens
acagcaatcccctcatcaacacgc

SEQ ID NO: 13247 - DNA, 25 bp, Homo sapiens
tgaagaaggaagccagagtacaact

SEQ ID NO: 13248 - DNA, 23 bp, Homo sapiens
gctcagtcttgtgctgctcactt

SEQ ID NO: 13249 - DNA, 25 bp, Homo sapiens
acaagagaaactgaaaggagtggaa

SEQ ID NO: 13250 - DNA, 25 bp, Homo sapiens
gtgctcagtgttggtggacaagtga

SEQ ID NO: 13251 - DNA, 25 bp, Homo sapiens
actggaccatgaatcctttgaaagc

SEQ ID NO: 13252 - DNA, 25 bp, Homo sapiens
ctcaccagagatattgtggatggca

SEQ ID NO: 13253 - DNA, 25 bp, Homo sapiens
tccttcctactcctgagacagttcc

SEQ ID NO: 13254 - DNA, 25 bp, Homo sapiens
ttggttacatacttggacttggtga

SEQ ID NO: 13255 - DNA, 24 bp, Homo sapiens
taactggaccagcagtgccctact

SEQ ID NO: 13256 - DNA, 24 bp, Homo sapiens
ataactggaccagcagtgccctac

SEQ ID NO: 13257 - DNA, 24 bp, Homo sapiens
aataactggaccagcagtgcccta

SEQ ID NO: 13258 - DNA, 24 bp, Homo sapiens
aaaaccgattgacaagagatgatt

SEQ ID NO: 13259 - DNA, 24 bp, Homo sapiens
gaaaaccgattgacaagagatgat

SEQ ID NO: 13260 - DNA, 24 bp, Homo sapiens
cgaaaaccgattgacaagagatga

SEQ ID NO: 13261 - DNA, 25 bp, Homo sapiens
tggaaagcatacagttggaccgaga

SEQ ID NO: 13262 - DNA, 23 bp, Homo sapiens
gccagagcccaacacccacaatg

SEQ ID NO: 13263 - DNA, 24 bp, Homo sapiens
acctgcggagatgagatgttgtca

SEQ ID NO: 13264 - DNA, 24 bp, Homo sapiens
agtagaggaaggtcgtctgatctt

SEQ ID NO: 13265 - DNA, 24 bp, Homo sapiens
gagtagaggaaggtcgtctgatct

SEQ ID NO: 13266 - DNA, 24 bp, Homo sapiens
ggagtagaggaaggtcgtctgatc

SEQ ID NO: 13267 - DNA, 24 bp, Homo sapiens
tgggcagattggaatgatccaggc

SEQ ID NO: 13268 - DNA, 24 bp, Homo sapiens
atgggcagattggaatgatccagg

SEQ ID NO: 13269 - DNA, 24 bp, Homo sapiens
tatgggcagattggaatgatccag

SEQ ID NO: 13270 - DNA, 24 bp, Homo sapiens
ggcagcagtggacctatgagcaga

SEQ ID NO: 13271 - DNA, 24 bp, Homo sapiens
gggcagcagtggacctatgagcag

SEQ ID NO: 13272 - DNA, 24 bp, Homo sapiens
cgggcagcagtggacctatgagca

SEQ ID NO: 13273 - DNA, 24 bp, Homo sapiens
caggggatgaagaacaagatcttg

SEQ ID NO: 13274 - DNA, 24 bp, Homo sapiens
gcaggggatgaagaacaagatctt

SEQ ID NO: 13275 - DNA, 24 bp, Homo sapiens
agcaggggatgaagaacaagatct

SEQ ID NO: 13276 - DNA, 24 bp, Homo sapiens
gctatcgtggctgtgactggtgac

SEQ ID NO: 13277 - DNA, 25 bp, Homo sapiens
actggagtagaggaaggtcgtctga

SEQ ID NO: 13278 - DNA, 24 bp, Homo sapiens
atgagcaggctgagagtgacatca

SEQ ID NO: 13279 - DNA, 25 bp, Homo sapiens
gccttcttcgtcagtatcgtggtgg

SEQ ID NO: 13280 - DNA, 25 bp, Homo sapiens
ccctggctgctttcctttcctactg

SEQ ID NO: 13281 - DNA, 24 bp, Homo sapiens
acctacctggtggttctgtgcctt

SEQ ID NO: 13282 - DNA, 24 bp, Homo sapiens
aattcctgctgacctcagaatcat

SEQ ID NO: 13283 - DNA, 24 bp, Homo sapiens
gaattcctgctgacctcagaatca

SEQ ID NO: 13284 - DNA, 24 bp, Homo sapiens
cgaattcctgctgacctcagaatc

SEQ ID NO: 13285 - DNA, 25 bp, Homo sapiens
ccctggctgctttcctttcctactg

SEQ ID NO: 13286 - DNA, 25 bp, Homo sapiens
gccttcttcgtcagtatcgtggtgg

SEQ ID NO: 13287 - DNA, 24 bp, Homo sapiens
gcagcagtggacctatgagcagag

SEQ ID NO: 13288 - DNA, 23 bp, Homo sapiens
gctcatcattgtggaaggctgcc

SEQ ID NO: 13289 - DNA, 24 bp, Homo sapiens
gctatcgtggctgtgactggtgac

SEQ ID NO: 13290 - DNA, 25 bp, Homo sapiens
ggattgctggctcagatgtgtccaa

SEQ ID NO: 13291 - DNA, 25 bp, Homo sapiens
gtgacggtgtgaatgactctccagc

SEQ ID NO: 13292 - DNA, 25 bp, Homo sapiens
ggattgctggctcagatgtgtccaa

SEQ ID NO: 13293 - DNA, 25 bp, Homo sapiens
actggagtagaggaaggtcgtctga

SEQ ID NO: 13294 - DNA, 25 bp, Homo sapiens
ctggtgacggtgtgaatgactctcc

SEQ ID NO: 13295 - DNA, 25 bp, Homo sapiens
ggattgctggctcagatgtgtccaa

SEQ ID NO: 13296 - DNA, 25 bp, Homo sapiens
tgctgacatgattcttctggatgac

SEQ ID NO: 13297 - DNA, 24 bp, Homo sapiens
tgagcaggctgagagtgacatcat

SEQ ID NO: 13298 - DNA, 23 bp, Homo sapiens
tctggctgagaacggcttcctcc

SEQ ID NO: 13299 - DNA, 24 bp, Homo sapiens
accgctggatcaacgatgtggaag

SEQ ID NO: 13300 - DNA, 24 bp, Homo sapiens
atgagcaggctgagagtgacatca

SEQ ID NO: 13301 - DNA, 23 bp, Homo sapiens
tctggctgagaacggcttcctcc

SEQ ID NO: 13302 - DNA, 24 bp, Homo sapiens
accgctggatcaacgatgtggaag

SEQ ID NO: 13303 - DNA, 25 bp, Homo sapiens
actggagtagaggaaggtcgtctga

SEQ ID NO: 13304 - DNA, 25 bp, Homo sapiens
ggattgctggctcagatgtgtccaa

SEQ ID NO: 13305 - DNA, 24 bp, Homo sapiens
gctatcgtggctgtgactggtgac

SEQ ID NO: 13306 - DNA, 23 bp, Homo sapiens
tctggctgagaacggcttcctcc

SEQ ID NO: 13307 - DNA, 24 bp, Homo sapiens
accgctggatcaacgatgtggaag

SEQ ID NO: 13308 - DNA, 24 bp, Homo sapiens
gcagcagtggacctatgagcagag

SEQ ID NO: 13309 - DNA, 23 bp, Homo sapiens
tctggctgagaacggcttcctcc

SEQ ID NO: 13310 - DNA, 24 bp, Homo sapiens
accgctggatcaacgatgtggaag

SEQ ID NO: 13311 - DNA, 23 bp, Homo sapiens
cctgttgggcctccgagtggact

SEQ ID NO: 13312 - DNA, 24 bp, Homo sapiens
atgagcaggctgagagtgacatca

SEQ ID NO: 13313 - DNA, 25 bp, Homo sapiens
actggagtagaggaaggtcgtctga

SEQ ID NO: 13314 - DNA, 25 bp, Homo sapiens
ggattgctggctcagatgtgtccaa

SEQ ID NO: 13315 - DNA, 23 bp, Homo sapiens
cttcgtcagtatcgtggtggtgc

SEQ ID NO: 13316 - DNA, 25 bp, Homo sapiens
gtcatctgtaagaccaggaggaatt

SEQ ID NO: 13317 - DNA, 23 bp, Homo sapiens
atcgtggagttcacctgccacac

SEQ ID NO: 13318 - DNA, 25 bp, Homo sapiens
gccttcttcgtcagtatcgtggtgg

SEQ ID NO: 13319 - DNA, 24 bp, Homo sapiens
gcagcagtggacctatgagcagag

SEQ ID NO: 13320 - DNA, 24 bp, Homo sapiens
accgctggatcaacgatgtggaag

SEQ ID NO: 13321 - DNA, 24 bp, Homo sapiens
cgggcagattggaatgatccaggc

SEQ ID NO: 13322 - DNA, 24 bp, Homo sapiens
acgggcagattggaatgatccagg

SEQ ID NO: 13323 - DNA, 24 bp, Homo sapiens
tacgggcagattggaatgatccag

SEQ ID NO: 13324 - DNA, 24 bp, Homo sapiens
agtcagaccagggagcccccgggc

SEQ ID NO: 13325 - DNA, 24 bp, Homo sapiens
gagtcagaccagggagcccccggg

SEQ ID NO: 13326 - DNA, 24 bp, Homo sapiens
ggagtcagaccagggagcccccgg

SEQ ID NO: 13327 - DNA, 24 bp, Homo sapiens
cgatgacagtgagatggagagccc

SEQ ID NO: 13328 - DNA, 24 bp, Homo sapiens
ctgcctgtgcttgctggagtcaga

SEQ ID NO: 13329 - DNA, 24 bp, Homo sapiens
cgtccatcatccagcagtcgagcc

SEQ ID NO: 13330 - DNA, 24 bp, Homo sapiens
ccactcagcccttctctcctccag

SEQ ID NO: 13331 - DNA, 24 bp, Homo sapiens
gaagcagcccagttctcagagagc

SEQ ID NO: 13332 - DNA, 24 bp, Homo sapiens
gcagccaagcagaaagaaacacgc

SEQ ID NO: 13333 - DNA, 24 bp, Homo sapiens
catccaaggtgaagtccagtagca

SEQ ID NO: 13334 - DNA, 24 bp, Homo sapiens
ccatccaaggtgaagtccagtagc

SEQ ID NO: 13335 - DNA, 24 bp, Homo sapiens
cccatccaaggtgaagtccagtag

SEQ ID NO: 13336 - DNA, 24 bp, Homo sapiens
gagcggattcaccaagcacaagca

SEQ ID NO: 13337 - DNA, 24 bp, Homo sapiens
gcaccagatgtcaccagcactcag

SEQ ID NO: 13338 - DNA, 24 bp, Homo sapiens
cgtcaccattctgtctcttgttcg

SEQ ID NO: 13339 - DNA, 25 bp, Homo sapiens
ttcctgtaaccttctctgccatcca

SEQ ID NO: 13340 - DNA, 25 bp, Homo sapiens
caccctgccctgcctttatgacaaa

SEQ ID NO: 13341 - DNA, 23 bp, Homo sapiens
gttcgctgtggtcaggctgtctc

SEQ ID NO: 13342 - DNA, 24 bp, Homo sapiens
gacagcagtggacctatgagcaac

SEQ ID NO: 13343 - DNA, 24 bp, Homo sapiens
ggacagcagtggacctatgagcaa

SEQ ID NO: 13344 - DNA, 24 bp, Homo sapiens
cggacagcagtggacctatgagca

SEQ ID NO: 13345 - DNA, 24 bp, Homo sapiens
aagatgtgaagatgatcagtgcag

SEQ ID NO: 13346 - DNA, 24 bp, Homo sapiens
gaagatgtgaagatgatcagtgca

SEQ ID NO: 13347 - DNA, 24 bp, Homo sapiens
tgaagatgtgaagatgatcagtgc

SEQ ID NO: 13348 - DNA, 24 bp, Homo sapiens
ccagcaaggacagcagcagttcag

SEQ ID NO: 13349 - DNA, 24 bp, Homo sapiens
ccagacacttgccaccaatgctca

SEQ ID NO: 13350 - DNA, 24 bp, Homo sapiens
caggttggagaaggtcagcaggtg

SEQ ID NO: 13351 - DNA, 24 bp, Homo sapiens
aaaagtcacaggacgtccagcagg

SEQ ID NO: 13352 - DNA, 24 bp, Homo sapiens
caaaagtcacaggacgtccagcag

SEQ ID NO: 13353 - DNA, 24 bp, Homo sapiens
acaaaagtcacaggacgtccagca

SEQ ID NO: 13354 - DNA, 24 bp, Homo sapiens
cagtttttcatgtgagtaggcata

SEQ ID NO: 13355 - DNA, 24 bp, Homo sapiens
ccagtttttcatgtgagtaggcat

SEQ ID NO: 13356 - DNA, 24 bp, Homo sapiens
cccagtttttcatgtgagtaggca

SEQ ID NO: 13357 - DNA, 25 bp, Homo sapiens
tctaactgccaccatcctggagaca

SEQ ID NO: 13358 - DNA, 24 bp, Homo sapiens
acaggatattaccacaacagcagc

SEQ ID NO: 13359 - DNA, 23 bp, Homo sapiens
aaagccttgcgtgacctgaccca

SEQ ID NO: 13360 - DNA, 24 bp, Homo sapiens
ccttgcgtgacctgacccaggtgc

SEQ ID NO: 13361 - DNA, 24 bp, Homo sapiens
gccttgcgtgacctgacccaggtg

SEQ ID NO: 13362 - DNA, 24 bp, Homo sapiens
agccttgcgtgacctgacccaggt

SEQ ID NO: 13363 - DNA, 24 bp, Homo sapiens
tttcctatttccactgtgacctgc

SEQ ID NO: 13364 - DNA, 24 bp, Homo sapiens
acaggatattaccacaacagcagc

SEQ ID NO: 13365 - DNA, 23 bp, Homo sapiens
gcagggctttcctttcaagtctt

SEQ ID NO: 13366 - DNA, 24 bp, Homo sapiens
attcctccagtgcctgagaaccga

SEQ ID NO: 13367 - DNA, 24 bp, Homo sapiens
aaggtcagttgattccagtgctaa

SEQ ID NO: 13368 - DNA, 25 bp, Homo sapiens
gcaagcagttcagaagagccaagga

SEQ ID NO: 13369 - DNA, 25 bp, Homo sapiens
tgatgacagcagtgaaactcctcct

SEQ ID NO: 13370 - DNA, 25 bp, Homo sapiens
gcagagattaagagcatatagacca

SEQ ID NO: 13371 - DNA, 23 bp, Homo sapiens
agatcaagatcctgttctgagtc

SEQ ID NO: 13372 - DNA, 24 bp, Homo sapiens
tcttgctctattgctcaggctgga

SEQ ID NO: 13373 - DNA, 24 bp, Homo sapiens
taacggttgcgtcggtgtaaagac

SEQ ID NO: 13374 - DNA, 24 bp, Homo sapiens
ggctcagaccagggcttctagacc

SEQ ID NO: 13375 - DNA, 24 bp, Homo sapiens
ccacggctcggcgtcccctccaga

SEQ ID NO: 13376 - DNA, 24 bp, Homo sapiens
gccacggctcggcgtcccctccag

SEQ ID NO: 13377 - DNA, 24 bp, Homo sapiens
cgccacggctcggcgtcccctcca

SEQ ID NO: 13378 - DNA, 24 bp, Homo sapiens
gtcggtagaggagaagtcgaggtt

SEQ ID NO: 13379 - DNA, 24 bp, Homo sapiens
agtcggtagaggagaagtcgaggt

SEQ ID NO: 13380 - DNA, 24 bp, Homo sapiens
cagtcggtagaggagaagtcgagg

SEQ ID NO: 13381 - DNA, 24 bp, Homo sapiens
ggctatgggaggtgctatgggcat

SEQ ID NO: 13382 - DNA, 24 bp, Homo sapiens
tggctatgggaggtgctatgggca

SEQ ID NO: 13383 - DNA, 24 bp, Homo sapiens
atggctatgggaggtgctatgggc

SEQ ID NO: 13384 - DNA, 24 bp, Homo sapiens
tcgaagttgagggtgcaaaaatgc

SEQ ID NO: 13385 - DNA, 24 bp, Homo sapiens
atcgaagttgagggtgcaaaaatg

SEQ ID NO: 13386 - DNA, 24 bp, Homo sapiens
aatcgaagttgagggtgcaaaaat

SEQ ID NO: 13387 - DNA, 24 bp, Homo sapiens
tccctgatgcgagagagcaggaga

SEQ ID NO: 13388 - DNA, 24 bp, Homo sapiens
ttccctgatgcgagagagcaggag

SEQ ID NO: 13389 - DNA, 24 bp, Homo sapiens
cttccctgatgcgagagagcagga

SEQ ID NO: 13390 - DNA, 24 bp, Homo sapiens
gtctctcagaacacagtgcaatca

SEQ ID NO: 13391 - DNA, 24 bp, Homo sapiens
actcaggattaagaaactcactca

SEQ ID NO: 13392 - DNA, 24 bp, Homo sapiens
cctgaatgactactgggtaaataa

SEQ ID NO: 13393 - DNA, 24 bp, Homo sapiens
cgccgttactccgaggagatacca

SEQ ID NO: 13394 - DNA, 24 bp, Homo sapiens
tagagggaactgggaggcactttg

SEQ ID NO: 13395 - DNA, 24 bp, Homo sapiens
atcaacatcaccaccagcagcagc

SEQ ID NO: 13396 - DNA, 24 bp, Homo sapiens
ggaactgggaggcactttgctgtc

SEQ ID NO: 13397 - DNA, 24 bp, Homo sapiens
ccgtgtagcgtcgccgttactccg

SEQ ID NO: 13398 - DNA, 24 bp, Homo sapiens
tccaggacctgccactatgatgcc

SEQ ID NO: 13399 - DNA, 24 bp, Homo sapiens
acagaggtgccatgccccctgctc

SEQ ID NO: 13400 - DNA, 24 bp, Homo sapiens
caggctggagtgtagtggcatgat

SEQ ID NO: 13401 - DNA, 24 bp, Homo sapiens
atcttgaactcctgacctcgtgat

SEQ ID NO: 13402 - DNA, 24 bp, Homo sapiens
ccaacctcacttgcttcttatcct

SEQ ID NO: 13403 - DNA, 24 bp, Homo sapiens
ccccagagaaactgccacatacac

SEQ ID NO: 13404 - DNA, 24 bp, Homo sapiens
gccccagagaaactgccacataca

SEQ ID NO: 13405 - DNA, 24 bp, Homo sapiens
agccccagagaaactgccacatac

SEQ ID NO: 13406 - DNA, 24 bp, Homo sapiens
gaactcctcctgcattcaaccgtg

SEQ ID NO: 13407 - DNA, 24 bp, Homo sapiens
tggtcaggctgctacaatggaagg

SEQ ID NO: 13408 - DNA, 24 bp, Homo sapiens
tccaggacctgccactatgatgcc

SEQ ID NO: 13409 - DNA, 24 bp, Homo sapiens
tagccccattgctccattcactcc

SEQ ID NO: 13410 - DNA, 24 bp, Homo sapiens
ccatcttgtttcatttgcttgccc

SEQ ID NO: 13411 - DNA, 24 bp, Homo sapiens
caggctggagtgtagtggcatgat

SEQ ID NO: 13412 - DNA, 24 bp, Homo sapiens
atcttgaactcctgacctcgtgat

SEQ ID NO: 13413 - DNA, 24 bp, Homo sapiens
ccatccctcagctccacaatgcag

SEQ ID NO: 13414 - DNA, 24 bp, Homo sapiens
tccatccctcagctccacaatgca

SEQ ID NO: 13415 - DNA, 24 bp, Homo sapiens
ctccatccctcagctccacaatgc

SEQ ID NO: 13416 - DNA, 24 bp, Homo sapiens
aggaaatgcaggcgggtaaacacc

SEQ ID NO: 13417 - DNA, 24 bp, Homo sapiens
gaggaaatgcaggcgggtaaacac

SEQ ID NO: 13418 - DNA, 24 bp, Homo sapiens
agaggaaatgcaggcgggtaaaca

SEQ ID NO: 13419 - DNA, 24 bp, Homo sapiens
ggacttgattgtgtcattaagcaa

SEQ ID NO: 13420 - DNA, 24 bp, Homo sapiens
aggacttgattgtgtcattaagca

SEQ ID NO: 13421 - DNA, 24 bp, Homo sapiens
aaggacttgattgtgtcattaagc

SEQ ID NO: 13422 - DNA, 24 bp, Homo sapiens
catcatcacaggtattccagcgtc

SEQ ID NO: 13423 - DNA, 24 bp, Homo sapiens
ccatcatcacaggtattccagcgt

SEQ ID NO: 13424 - DNA, 24 bp, Homo sapiens
gccatcatcacaggtattccagcg

SEQ ID NO: 13425 - DNA, 23 bp, Homo sapiens
ttggcaagttgatggcaaggact

SEQ ID NO: 13426 - DNA, 25 bp, Homo sapiens
gcagtggtcctagcatccatcttgt

SEQ ID NO: 13427 - DNA, 25 bp, Homo sapiens
aagagttcataaggaggtgagaagt

SEQ ID NO: 13428 - DNA, 25 bp, Homo sapiens
gacaggagaaaagcaaacagaaacc

SEQ ID NO: 13429 - DNA, 24 bp, Homo sapiens
tgtacctctttcttcagaattaaa

SEQ ID NO: 13430 - DNA, 25 bp, Homo sapiens
taacctgacgctaaaactaaaaaca

SEQ ID NO: 13431 - DNA, 25 bp, Homo sapiens
atcgcaaacatttggctagtgtacg

SEQ ID NO: 13432 - DNA, 25 bp, Homo sapiens
ggtccaagtgccagtgcttatgtaa

SEQ ID NO: 13433 - DNA, 24 bp, Homo sapiens
tccggtcagaagacgctctcagag

SEQ ID NO: 13434 - DNA, 25 bp, Homo sapiens
atcgcaaacatttggctagtgtacg

SEQ ID NO: 13435 - DNA, 25 bp, Homo sapiens
tcgtctttgttgtaggtttatctca

SEQ ID NO: 13436 - DNA, 25 bp, Homo sapiens
gctgcaaaggataaagaatgagaaa

SEQ ID NO: 13437 - DNA, 24 bp, Homo sapiens
atggagcccttggagatagatgat

SEQ ID NO: 13438 - DNA, 25 bp, Homo sapiens
cgtgaagatgtctcgcagtcctgat

SEQ ID NO: 13439 - DNA, 25 bp, Homo sapiens
ggcgggtcgtcaaagtcctacattt

SEQ ID NO: 13440 - DNA, 24 bp, Homo sapiens
cagtgctgaacttccttctccctt

SEQ ID NO: 13441 - DNA, 25 bp, Homo sapiens
cgtgaagatgtctcgcagtcctgat

SEQ ID NO: 13442 - DNA, 23 bp, Homo sapiens
gaagaccctgtggagtgccctct

SEQ ID NO: 13443 - DNA, 25 bp, Homo sapiens
tctttgttgtaggtttatctcagcg

SEQ ID NO: 13444 - DNA, 25 bp, Homo sapiens
atcgcaaacatttggctagtgtacg

SEQ ID NO: 13445 - DNA, 25 bp, Homo sapiens
agccatatccagaagacccagcagt

SEQ ID NO: 13446 - DNA, 23 bp, Homo sapiens
tgatacgccttcaccaccacctg

SEQ ID NO: 13447 - DNA, 25 bp, Homo sapiens
ccatcagttcatccaatcacagtgc

SEQ ID NO: 13448 - DNA, 24 bp, Homo sapiens
ggcagtaacagagtcacagtcgtt

SEQ ID NO: 13449 - DNA, 23 bp, Homo sapiens
tgatacgccttcaccaccacctg

SEQ ID NO: 13450 - DNA, 24 bp, Homo sapiens
ggcagtaacagagtcacagtcgtt

SEQ ID NO: 13451 - DNA, 24 bp, Homo sapiens
tacagcaccagaaccacagagcct

SEQ ID NO: 13452 - DNA, 25 bp, Homo sapiens
ccatcagttcatccaatcacagtgc

SEQ ID NO: 13453 - DNA, 24 bp, Homo sapiens
ggcagtaacagagtcacagtcgtt

SEQ ID NO: 13454 - DNA, 24 bp, Homo sapiens
tacagcaccagaaccacagagcct

SEQ ID NO: 13455 - DNA, 24 bp, Homo sapiens
ggcagtaacagagtcacagtcgtt

SEQ ID NO: 13456 - DNA, 25 bp, Homo sapiens
ccatcagttcatccaatcacagtgc

SEQ ID NO: 13457 - DNA, 24 bp, Homo sapiens
tttcgccatcccaaccctatccca

SEQ ID NO: 13458 - DNA, 24 bp, Homo sapiens
cctctacagactggcaagcagctt

SEQ ID NO: 13459 - DNA, 25 bp, Homo sapiens
actgtccgttcaagaccaaccttcc

SEQ ID NO: 13460 - DNA, 25 bp, Homo sapiens
ccacatctcttcagaactcctcttc

SEQ ID NO: 13461 - DNA, 24 bp, Homo sapiens
tttcgccatcccaaccctatccca

SEQ ID NO: 13462 - DNA, 23 bp, Homo sapiens
ggcagtaacagagtcacagtcgt

SEQ ID NO: 13463 - DNA, 25 bp, Homo sapiens
ccatcagttcatccaatcacagtgc

SEQ ID NO: 13464 - DNA, 24 bp, Homo sapiens
gtgtcttccagattctgattcgca

SEQ ID NO: 13465 - DNA, 24 bp, Homo sapiens
ggtgtcttccagattctgattcgc

SEQ ID NO: 13466 - DNA, 24 bp, Homo sapiens
aggtgtcttccagattctgattcg

SEQ ID NO: 13467 - DNA, 24 bp, Homo sapiens
aggacaacaaggaagagacacctc

SEQ ID NO: 13468 - DNA, 24 bp, Homo sapiens
caggacaacaaggaagagacacct

SEQ ID NO: 13469 - DNA, 24 bp, Homo sapiens
gcaggacaacaaggaagagacacc

SEQ ID NO: 13470 - DNA, 24 bp, Homo sapiens
atgtgccatggccaatagcaatcc

SEQ ID NO: 13471 - DNA, 24 bp, Homo sapiens
aatgtgccatggccaatagcaatc

SEQ ID NO: 13472 - DNA, 24 bp, Homo sapiens
gaatgtgccatggccaatagcaat

SEQ ID NO: 13473 - DNA, 24 bp, Homo sapiens
gtgcatgccaggtttcaaaggtgt

SEQ ID NO: 13474 - DNA, 24 bp, Homo sapiens
tgtgcatgccaggtttcaaaggtg

SEQ ID NO: 13475 - DNA, 24 bp, Homo sapiens
ctgtgcatgccaggtttcaaaggt

SEQ ID NO: 13476 - DNA, 24 bp, Homo sapiens
gctggcaacacgcattactgtcag

SEQ ID NO: 13477 - DNA, 24 bp, Homo sapiens
ttggtggatacagatgcgagtgtg

SEQ ID NO: 13478 - DNA, 24 bp, Homo sapiens
aggattggaggctacagttgtcgc

SEQ ID NO: 13479 - DNA, 24 bp, Homo sapiens
tgttacctaccacaatggcacagg

SEQ ID NO: 13480 - DNA, 24 bp, Homo sapiens
tgtgagaagaaccgctgccagaat

SEQ ID NO: 13481 - DNA, 24 bp, Homo sapiens
gtgccgatgtgcctcagggtttac

SEQ ID NO: 13482 - DNA, 24 bp, Homo sapiens
tgtgagaagaaccgctgccagaat

SEQ ID NO: 13483 - DNA, 24 bp, Homo sapiens
gtgccgatgtgcctcagggtttac

SEQ ID NO: 13484 - DNA, 24 bp, Homo sapiens
tccatgctttgtgtctcgaccctg

SEQ ID NO: 13485 - DNA, 24 bp, Homo sapiens
gtgccgatgtgcctcagggtttac

SEQ ID NO: 13486 - DNA, 24 bp, Homo sapiens
tgtgagaagaaccgctgccagaat

SEQ ID NO: 13487 - DNA, 24 bp, Homo sapiens
gcagtgtcgagatggctatgaacc

SEQ ID NO: 13488 - DNA, 24 bp, Homo sapiens
gccaatagcaatccttgtgagcat

SEQ ID NO: 13489 - DNA, 24 bp, Homo sapiens
gcaggacctcgttgtgagatggac

SEQ ID NO: 13490 - DNA, 24 bp, Homo sapiens
cctgccagaatgatgctacctgtc

SEQ ID NO: 13491 - DNA, 24 bp, Homo sapiens
gcaggacctcgttgtgagatggac

SEQ ID NO: 13492 - DNA, 24 bp, Homo sapiens
cctgccagaatgatgctacctgtc

SEQ ID NO: 13493 - DNA, 24 bp, Homo sapiens
tgtgaacaatgggcagtgtgtgga

SEQ ID NO: 13494 - DNA, 24 bp, Homo sapiens
gcaggacctcgttgtgagatggac

SEQ ID NO: 13495 - DNA, 24 bp, Homo sapiens
acctgtctggataagattggaggc

SEQ ID NO: 13496 - DNA, 24 bp, Homo sapiens
cgccttccactgtgagtgtctgaa

SEQ ID NO: 13497 - DNA, 24 bp, Homo sapiens
gccagaatcagccctgccagaatg

SEQ ID NO: 13498 - DNA, 24 bp, Homo sapiens
cctgtattgaccttgtgaaccatt

SEQ ID NO: 13499 - DNA, 24 bp, Homo sapiens
ggtgtcaactgtgagtatgaagtg

SEQ ID NO: 13500 - DNA, 24 bp, Homo sapiens
gaatggagggacttgtgctgtggc

SEQ ID NO: 13501 - DNA, 24 bp, Homo sapiens
gatggtttcatttgccgttgtccc

SEQ ID NO: 13502 - DNA, 24 bp, Homo sapiens
cgccagcctccttattactcctgc

SEQ ID NO: 13503 - DNA, 24 bp, Homo sapiens
atggacacagcagcaccttgaagc

SEQ ID NO: 13504 - DNA, 24 bp, Homo sapiens
gtaggacaccatcgctggctctca

SEQ ID NO: 13505 - DNA, 24 bp, Homo sapiens
gcagagcaggaggtggatgtgtta

SEQ ID NO: 13506 - DNA, 25 bp, Homo sapiens
cagcaggagaaccagaaccagagtg

SEQ ID NO: 13507 - DNA, 23 bp, Homo sapiens
aactgtgattgaaccgatggcat

SEQ ID NO: 13508 - DNA, 25 bp, Homo sapiens
aaagtattcagaccaagggaccgtg

SEQ ID NO: 13509 - DNA, 24 bp, Homo sapiens
gcagatgctgtgggtaaacctcat

SEQ ID NO: 13510 - DNA, 23 bp, Homo sapiens
tacactcgcttccctggctctgg

SEQ ID NO: 13511 - DNA, 25 bp, Homo sapiens
aaccacccactgagtctctcttgct

SEQ ID NO: 13512 - DNA, 24 bp, Homo sapiens
cctgcctcttgctgtcaccatctc

SEQ ID NO: 13513 - DNA, 24 bp, Homo sapiens
cattggtgtcactgtgctggtcgt

SEQ ID NO: 13514 - DNA, 25 bp, Homo sapiens
gtctgccatcaccgtcatcatcctg

SEQ ID NO: 13515 - DNA, 24 bp, Homo sapiens
ggttcaagcgattctcctgcctca

SEQ ID NO: 13516 - DNA, 24 bp, Homo sapiens
agtccagtggtgcaatctcggctc

SEQ ID NO: 13517 - DNA, 24 bp, Homo sapiens
tgagtagctgggattacaggcatg

SEQ ID NO: 13518 - DNA, 24 bp, Homo sapiens
ccaacaccatggtaaggaaacaga

SEQ ID NO: 13519 - DNA, 24 bp, Homo sapiens
accaacaccatggtaaggaaacag

SEQ ID NO: 13520 - DNA, 24 bp, Homo sapiens
caccaacaccatggtaaggaaaca

SEQ ID NO: 13521 - DNA, 24 bp, Homo sapiens
agatccaaatgcttctgctgccca

SEQ ID NO: 13522 - DNA, 25 bp, Homo sapiens
ttctccagcagcacatcaatagtct

SEQ ID NO: 13523 - DNA, 25 bp, Homo sapiens
ccagaaggctcttactacacctact

SEQ ID NO: 13524 - DNA, 25 bp, Homo sapiens
ccagcaggtattattctcactaagg

SEQ ID NO: 13525 - DNA, 23 bp, Homo sapiens
atgcgtgctgctttgcgaaatgg

SEQ ID NO: 13526 - DNA, 25 bp, Homo sapiens
acagcaacagcaacagtgtggatga

SEQ ID NO: 13527 - DNA, 24 bp, Homo sapiens
gttttgccatgggcatcgcaggca

SEQ ID NO: 13528 - DNA, 24 bp, Homo sapiens
ggttttgccatgggcatcgcaggc

SEQ ID NO: 13529 - DNA, 24 bp, Homo sapiens
tggttttgccatgggcatcgcagg

SEQ ID NO: 13530 - DNA, 25 bp, Homo sapiens
atggtgacaggtgacaacatcaaca

SEQ ID NO: 13531 - DNA, 23 bp, Homo sapiens
acctggggatgacttcctgtgct

SEQ ID NO: 13532 - DNA, 23 bp, Homo sapiens
gcaaagaattcaaccggctcatc

SEQ ID NO: 13533 - DNA, 24 bp, Homo sapiens
gcaggagggagtttgtgtttgaaa

SEQ ID NO: 13534 - DNA, 24 bp, Homo sapiens
agcaggagggagtttgtgtttgaa

SEQ ID NO: 13535 - DNA, 24 bp, Homo sapiens
cagcaggagggagtttgtgtttga

SEQ ID NO: 13536 - DNA, 24 bp, Homo sapiens
cagcgttggacaaatactttccgt

SEQ ID NO: 13537 - DNA, 24 bp, Homo sapiens
ccagcgttggacaaatactttccg

SEQ ID NO: 13538 - DNA, 24 bp, Homo sapiens
cccagcgttggacaaatactttcc

SEQ ID NO: 13539 - DNA, 24 bp, Homo sapiens
tggagtgagaatcatagctgagcc

SEQ ID NO: 13540 - DNA, 24 bp, Homo sapiens
tactatgttgcatcagctttcacg

SEQ ID NO: 13541 - DNA, 24 bp, Homo sapiens
gttaatatcattgccaagaaaatt

SEQ ID NO: 13542 - DNA, 24 bp, Homo sapiens
tggagtgagaatcatagctgagcc

SEQ ID NO: 13543 - DNA, 24 bp, Homo sapiens
cagcgttggacaaatactttccgt

SEQ ID NO: 13544 - DNA, 24 bp, Homo sapiens
actatgttgcatcagctttcacgc

SEQ ID NO: 13545 - DNA, 23 bp, Homo sapiens
agtccctggtagaagcacagccc

SEQ ID NO: 13546 - DNA, 25 bp, Homo sapiens
gtggaggagatgtactgtgcttggc

SEQ ID NO: 13547 - DNA, 25 bp, Homo sapiens
aggacatttcaacagattcggtgct

SEQ ID NO: 13548 - DNA, 23 bp, Homo sapiens
ggctctagcggagtacatggcgt

SEQ ID NO: 13549 - DNA, 23 bp, Homo sapiens
ggcatccacattcggctgagcgg

SEQ ID NO: 13550 - DNA, 23 bp, Homo sapiens
gcacattcagccaccgccaccat

SEQ ID NO: 13551 - DNA, 24 bp, Homo sapiens
ctcttgacctcgtgatctgcctgc

SEQ ID NO: 13552 - DNA, 24 bp, Homo sapiens
tgggattacagacctgagccaccg

SEQ ID NO: 13553 - DNA, 24 bp, Homo sapiens
agatggggtttcaccatgttggcc

SEQ ID NO: 13554 - DNA, 23 bp, Homo sapiens
caattctcctgcctcagcctccc

SEQ ID NO: 13555 - DNA, 23 bp, Homo sapiens
ggctggagtgcaatggcgcaatc

SEQ ID NO: 13556 - DNA, 23 bp, Homo sapiens
cactgcgacttccgcctcccagg

SEQ ID NO: 13557 - DNA, 24 bp, Homo sapiens
ctatgaagcaggtagcaggtacca

SEQ ID NO: 13558 - DNA, 24 bp, Homo sapiens
gctatgaagcaggtagcaggtacc

SEQ ID NO: 13559 - DNA, 24 bp, Homo sapiens
ggctatgaagcaggtagcaggtac

SEQ ID NO: 13560 - DNA, 25 bp, Homo sapiens
tgaacttggaacctgacaatgttgg

SEQ ID NO: 13561 - DNA, 25 bp, Homo sapiens
agtgaagaggacaggagccattgtg

SEQ ID NO: 13562 - DNA, 24 bp, Homo sapiens
ggtcgtgtagttgatgcccttggt

SEQ ID NO: 13563 - DNA, 25 bp, Homo sapiens
tccatgcctctaacactcatcttca

SEQ ID NO: 13564 - DNA, 25 bp, Homo sapiens
ctacgccgcacttactagatgaaga

SEQ ID NO: 13565 - DNA, 25 bp, Homo sapiens
ccatgcctctaacactcatcttcaa

SEQ ID NO: 13566 - DNA, 23 bp, Homo sapiens
ggttcatctttcattgctgcaag

SEQ ID NO: 13567 - DNA, 24 bp, Homo sapiens
ccgatcggcggcttcgggctgccg

SEQ ID NO: 13568 - DNA, 24 bp, Homo sapiens
accgatcggcggcttcgggctgcc

SEQ ID NO: 13569 - DNA, 24 bp, Homo sapiens
gaccgatcggcggcttcgggctgc

SEQ ID NO: 13570 - DNA, 24 bp, Homo sapiens
gtgtcctccagccctgcccttctc

SEQ ID NO: 13571 - DNA, 24 bp, Homo sapiens
ggtgtcctccagccctgcccttct

SEQ ID NO: 13572 - DNA, 24 bp, Homo sapiens
tggtgtcctccagccctgcccttc

SEQ ID NO: 13573 - DNA, 25 bp, Homo sapiens
ccagtctttggctcatccaggcttt

SEQ ID NO: 13574 - DNA, 25 bp, Homo sapiens
aggcagaagaggacaagttagaaca

SEQ ID NO: 13575 - DNA, 25 bp, Homo sapiens
aatgggcagagaagttagatcggct

SEQ ID NO: 13576 - DNA, 25 bp, Homo sapiens
aaggcaactggatgaaggcgagatt

SEQ ID NO: 13577 - DNA, 23 bp, Homo sapiens
catacggaactgtggatggaaca

SEQ ID NO: 13578 - DNA, 25 bp, Homo sapiens
tctaacggctgaggactgctttgag

SEQ ID NO: 13579 - DNA, 25 bp, Homo sapiens
aagcaaggaagaagtctctatcact

SEQ ID NO: 13580 - DNA, 23 bp, Homo sapiens
cccaaggcccgtccacatgtctg

SEQ ID NO: 13581 - DNA, 24 bp, Homo sapiens
gggatgatgacgatctcgaggacc

SEQ ID NO: 13582 - DNA, 24 bp, Homo sapiens
ggggatgatgacgatctcgaggac

SEQ ID NO: 13583 - DNA, 24 bp, Homo sapiens
aggggatgatgacgatctcgagga

SEQ ID NO: 13584 - DNA, 24 bp, Homo sapiens
cctccctgcaggactttgtgttgc

SEQ ID NO: 13585 - DNA, 24 bp, Homo sapiens
tcctccctgcaggactttgtgttg

SEQ ID NO: 13586 - DNA, 24 bp, Homo sapiens
ctcctccctgcaggactttgtgtt

SEQ ID NO: 13587 - DNA, 24 bp, Homo sapiens
ccgcgtgggaggactttgtgttgc

SEQ ID NO: 13588 - DNA, 24 bp, Homo sapiens
accgcgtgggaggactttgtgttg

SEQ ID NO: 13589 - DNA, 24 bp, Homo sapiens
aaccgcgtgggaggactttgtgtt

SEQ ID NO: 13590 - DNA, 24 bp, Homo sapiens
aagtgactgagtgcgaggttaaaa

SEQ ID NO: 13591 - DNA, 24 bp, Homo sapiens
gaagtgactgagtgcgaggttaaa

SEQ ID NO: 13592 - DNA, 24 bp, Homo sapiens
cgaagtgactgagtgcgaggttaa

SEQ ID NO: 13593 - DNA, 24 bp, Homo sapiens
gaggctgcaaggaaagcaaagcaa

SEQ ID NO: 13594 - DNA, 24 bp, Homo sapiens
tgaggctgcaaggaaagcaaagca

SEQ ID NO: 13595 - DNA, 24 bp, Homo sapiens
atgaggctgcaaggaaagcaaagc

SEQ ID NO: 13596 - DNA, 24 bp, Homo sapiens
ggagaaaaaacgtgagacagctag

SEQ ID NO: 13597 - DNA, 24 bp, Homo sapiens
aggagaaaaaacgtgagacagcta

SEQ ID NO: 13598 - DNA, 24 bp, Homo sapiens
gaggagaaaaaacgtgagacagct

SEQ ID NO: 13599 - DNA, 25 bp, Homo sapiens
agttgcctgtggttctccctcctat

SEQ ID NO: 13600 - DNA, 24 bp, Homo sapiens
gtccattcctcagccattgcctcc

SEQ ID NO: 13601 - DNA, 25 bp, Homo sapiens
catcattgtcttctgcgacttcagg

SEQ ID NO: 13602 - DNA, 25 bp, Homo sapiens
agttgcctgtggttctccctcctat

SEQ ID NO: 13603 - DNA, 24 bp, Homo sapiens
gtccattcctcagccattgcctcc

SEQ ID NO: 13604 - DNA, 25 bp, Homo sapiens
tcctcccttaatgatgcccactccc

SEQ ID NO: 13605 - DNA, 24 bp, Homo sapiens
cagagtctcaccacattgcccagg

SEQ ID NO: 13606 - DNA, 24 bp, Homo sapiens
acccgccaccacacccagctattt

SEQ ID NO: 13607 - DNA, 24 bp, Homo sapiens
caattctcatgcctcagcctcctg

SEQ ID NO: 13608 - DNA, 24 bp, Homo sapiens
cgacctcgctggcaagccctccct

SEQ ID NO: 13609 - DNA, 24 bp, Homo sapiens
ccgacctcgctggcaagccctccc

SEQ ID NO: 13610 - DNA, 24 bp, Homo sapiens
cccgacctcgctggcaagccctcc

SEQ ID NO: 13611 - DNA, 24 bp, Homo sapiens
aaaagtgacgggatccggaaagta

SEQ ID NO: 13612 - DNA, 24 bp, Homo sapiens
gaaaagtgacgggatccggaaagt

SEQ ID NO: 13613 - DNA, 24 bp, Homo sapiens
agaaaagtgacgggatccggaaag

SEQ ID NO: 13614 - DNA, 24 bp, Homo sapiens
tgcttccacagtggcactaaggaa

SEQ ID NO: 13615 - DNA, 24 bp, Homo sapiens
ttgcttccacagtggcactaagga

SEQ ID NO: 13616 - DNA, 24 bp, Homo sapiens
attgcttccacagtggcactaagg

SEQ ID NO: 13617 - DNA, 24 bp, Homo sapiens
tgaaaaatctgctccagggtttga

SEQ ID NO: 13618 - DNA, 24 bp, Homo sapiens
ctgaaaaatctgctccagggtttg

SEQ ID NO: 13619 - DNA, 24 bp, Homo sapiens
gctgaaaaatctgctccagggttt

SEQ ID NO: 13620 - DNA, 23 bp, Homo sapiens
ccaccatcccgcccgaaatcttt

SEQ ID NO: 13621 - DNA, 23 bp, Homo sapiens
aagccaccacctggagacctgcc

SEQ ID NO: 13622 - DNA, 23 bp, Homo sapiens
ttgccgcctaagccaggagaact

SEQ ID NO: 13623 - DNA, 25 bp, Homo sapiens
agggcaataaggaatatggcagtga

SEQ ID NO: 13624 - DNA, 25 bp, Homo sapiens
aacagctaactgcactccgagactt

SEQ ID NO: 13625 - DNA, 25 bp, Homo sapiens
acctgctaaagaaaagtgacgggat

SEQ ID NO: 13626 - DNA, 25 bp, Homo sapiens
tcctatggagccttcaccaaccaga

SEQ ID NO: 13627 - DNA, 23 bp, Homo sapiens
ccacatcaccaaccacggaggct

SEQ ID NO: 13628 - DNA, 25 bp, Homo sapiens
ttcaacactccctctaagcacccag

SEQ ID NO: 13629 - DNA, 23 bp, Homo sapiens
tatccgaccctcccagcccacta

SEQ ID NO: 13630 - DNA, 25 bp, Homo sapiens
ttcaacactccctctaagcacccag

SEQ ID NO: 13631 - DNA, 23 bp, Homo sapiens
ccacatcaccaaccacggaggct

SEQ ID NO: 13632 - DNA, 23 bp, Homo sapiens
ccaccatcccgcccgaaatcttt

SEQ ID NO: 13633 - DNA, 23 bp, Homo sapiens
ttgccgcctaagccaggagaact

SEQ ID NO: 13634 - DNA, 25 bp, Homo sapiens
cccaactctcagacttacctcccaa

SEQ ID NO: 13635 - DNA, 23 bp, Homo sapiens
aaggaactgtccacactgctgaa

SEQ ID NO: 13636 - DNA, 23 bp, Homo sapiens
ctccagggtttgagccacaatgt

SEQ ID NO: 13637 - DNA, 25 bp, Homo sapiens
aggagacctaaagggagtcaaagga

SEQ ID NO: 13638 - DNA, 23 bp, Homo sapiens
tcacgctgctggaggaggctcta

SEQ ID NO: 13639 - DNA, 23 bp, Homo sapiens
aaggaactgtccacactgctgaa

SEQ ID NO: 13640 - DNA, 23 bp, Homo sapiens
ctccagggtttgagccacaatgt

SEQ ID NO: 13641 - DNA, 25 bp, Homo sapiens
tgatccgcacagagataacaggagc

SEQ ID NO: 13642 - DNA, 25 bp, Homo sapiens
gcggaagaaatggagaaggaaaggc

SEQ ID NO: 13643 - DNA, 25 bp, Homo sapiens
aacagctaactgcactccgagactt

SEQ ID NO: 13644 - DNA, 25 bp, Homo sapiens
agggcaataaggaatatggcagtga

SEQ ID NO: 13645 - DNA, 25 bp, Homo sapiens
aacagctaactgcactccgagactt

SEQ ID NO: 13646 - DNA, 25 bp, Homo sapiens
gcggaagaaatggagaaggaaaggc

SEQ ID NO: 13647 - DNA, 25 bp, Homo sapiens
ctggagaaactgccctagacatagc

SEQ ID NO: 13648 - DNA, 25 bp, Homo sapiens
tcctatggagccttcaccaaccaga

SEQ ID NO: 13649 - DNA, 23 bp, Homo sapiens
ccacatcaccaaccacggaggct

SEQ ID NO: 13650 - DNA, 24 bp, Homo sapiens
acactccctctaagcacccagacc

SEQ ID NO: 13651 - DNA, 23 bp, Homo sapiens
tatccgaccctcccagcccacta

SEQ ID NO: 13652 - DNA, 23 bp, Homo sapiens
ccaccatcccgcccgaaatcttt

SEQ ID NO: 13653 - DNA, 24 bp, Homo sapiens
gcaacctcctcctccagaggtact

SEQ ID NO: 13654 - DNA, 24 bp, Homo sapiens
tgcaacctcctcctccagaggtac

SEQ ID NO: 13655 - DNA, 24 bp, Homo sapiens
ctgcaacctcctcctccagaggta

SEQ ID NO: 13656 - DNA, 24 bp, Homo sapiens
gcaacctcctcctcccaggtacaa

SEQ ID NO: 13657 - DNA, 24 bp, Homo sapiens
tgcaacctcctcctcccaggtaca

SEQ ID NO: 13658 - DNA, 24 bp, Homo sapiens
ctgcaacctcctcctcccaggtac

SEQ ID NO: 13659 - DNA, 24 bp, Homo sapiens
ctcttgatccgcctgccttggcct

SEQ ID NO: 13660 - DNA, 24 bp, Homo sapiens
cctcttgatccgcctgccttggcc

SEQ ID NO: 13661 - DNA, 24 bp, Homo sapiens
acctcttgatccgcctgccttggc

SEQ ID NO: 13662 - DNA, 24 bp, Homo sapiens
ctgaggcaggcgcggatcacctga

SEQ ID NO: 13663 - DNA, 24 bp, Homo sapiens
gctgaggcaggcgcggatcacctg

SEQ ID NO: 13664 - DNA, 24 bp, Homo sapiens
ggctgaggcaggcgcggatcacct

SEQ ID NO: 13665 - DNA, 25 bp, Homo sapiens
ggagttcaagatcagcctgaccaac

SEQ ID NO: 13666 - DNA, 24 bp, Homo sapiens
catagtggtgcatgcctgtaatcc

SEQ ID NO: 13667 - DNA, 23 bp, Homo sapiens
ctcaggagcctggcaacaagagc

SEQ ID NO: 13668 - DNA, 24 bp, Homo sapiens
cacagccagatttgaccaagctgc

SEQ ID NO: 13669 - DNA, 24 bp, Homo sapiens
ccacagccagatttgaccaagctg

SEQ ID NO: 13670 - DNA, 24 bp, Homo sapiens
tccacagccagatttgaccaagct

SEQ ID NO: 13671 - DNA, 24 bp, Homo sapiens
aggctattgggcaggtttggatgc

SEQ ID NO: 13672 - DNA, 24 bp, Homo sapiens
aaggctattgggcaggtttggatg

SEQ ID NO: 13673 - DNA, 24 bp, Homo sapiens
aaaggctattgggcaggtttggat

SEQ ID NO: 13674 - DNA, 24 bp, Homo sapiens
ttccaaacgatttgattggctgca

SEQ ID NO: 13675 - DNA, 24 bp, Homo sapiens
attccaaacgatttgattggctgc

SEQ ID NO: 13676 - DNA, 24 bp, Homo sapiens
cattccaaacgatttgattggctg

SEQ ID NO: 13677 - DNA, 24 bp, Homo sapiens
tgcgcgaggagagtggtgcacgta

SEQ ID NO: 13678 - DNA, 24 bp, Homo sapiens
atgcgcgaggagagtggtgcacgt

SEQ ID NO: 13679 - DNA, 24 bp, Homo sapiens
gatgcgcgaggagagtggtgcacg

SEQ ID NO: 13680 - DNA, 24 bp, Homo sapiens
aactggaagaggacataagcagct

SEQ ID NO: 13681 - DNA, 24 bp, Homo sapiens
aaactggaagaggacataagcagc

SEQ ID NO: 13682 - DNA, 24 bp, Homo sapiens
caaactggaagaggacataagcag

SEQ ID NO: 13683 - DNA, 25 bp, Homo sapiens
aaggagaatcagttaagaagatgcg

SEQ ID NO: 13684 - DNA, 23 bp, Homo sapiens
atgtgcctcaaccctgacctgga

SEQ ID NO: 13685 - DNA, 24 bp, Homo sapiens
gcctataccattcaaggacagtat

SEQ ID NO: 13686 - DNA, 23 bp, Homo sapiens
gacagtgcgagctttccccacac

SEQ ID NO: 13687 - DNA, 23 bp, Homo sapiens
cccgtccatgtgcctcaaccctg

SEQ ID NO: 13688 - DNA, 23 bp, Homo sapiens
agcgacagtgcgagctttcccca

SEQ ID NO: 13689 - DNA, 25 bp, Homo sapiens
acagtatgccattccacagccagat

SEQ ID NO: 13690 - DNA, 25 bp, Homo sapiens
acttctcatgaactcaccattccaa

SEQ ID NO: 13691 - DNA, 23 bp, Homo sapiens
cccgtccatgtgcctcaaccctg

SEQ ID NO: 13692 - DNA, 23 bp, Homo sapiens
tcaggacaggtacagcacaggca

SEQ ID NO: 13693 - DNA, 24 bp, Homo sapiens
gtccagctctccggtcatctttgc

SEQ ID NO: 13694 - DNA, 25 bp, Homo sapiens
aacagtctcattttcccatgacgca

SEQ ID NO: 13695 - DNA, 23 bp, Homo sapiens
gctcaggctggtctccaactcct

SEQ ID NO: 13696 - DNA, 24 bp, Homo sapiens
gatgattcgactgccttggtctcc

SEQ ID NO: 13697 - DNA, 25 bp, Homo sapiens
agtcagtgtggctctctcattggaa

SEQ ID NO: 13698 - DNA, 23 bp, Homo sapiens
aactggaagaggacataagcagc

SEQ ID NO: 13699 - DNA, 25 bp, Homo sapiens
acccactaatgccatcttcaaagcc

SEQ ID NO: 13700 - DNA, 25 bp, Homo sapiens
ctgcgtggtcatgttggagactctc

SEQ ID NO: 13701 - DNA, 23 bp, Homo sapiens
tcaggacaggtacagcacaggca

SEQ ID NO: 13702 - DNA, 23 bp, Homo sapiens
atgtgcctcaaccctgacctgga

SEQ ID NO: 13703 - DNA, 25 bp, Homo sapiens
tcaatgagatccgtcagatgtctgg

SEQ ID NO: 13704 - DNA, 23 bp, Homo sapiens
tggctgcataatcgggcgtcaag

SEQ ID NO: 13705 - DNA, 25 bp, Homo sapiens
ctactgataggcaggttaccatcac

SEQ ID NO: 13706 - DNA, 25 bp, Homo sapiens
gagaatcagttaagaagatgcgcga

SEQ ID NO: 13707 - DNA, 25 bp, Homo sapiens
aaggaagttggcagtatcatcggaa

SEQ ID NO: 13708 - DNA, 25 bp, Homo sapiens
tgtcactctcaccatccggctactt

SEQ ID NO: 13709 - DNA, 23 bp, Homo sapiens
aacactgctcgacatggacaccg

SEQ ID NO: 13710 - DNA, 23 bp, Homo sapiens
tcaggacaggtacagcacaggca

SEQ ID NO: 13711 - DNA, 23 bp, Homo sapiens
atgtgcctcaaccctgacctgga

SEQ ID NO: 13712 - DNA, 25 bp, Homo sapiens
gacagtatgccattccacagccaga

SEQ ID NO: 13713 - DNA, 24 bp, Homo sapiens
caagcaattctcctgcctcagcct

SEQ ID NO: 13714 - DNA, 24 bp, Homo sapiens
tgaaattacctctcaggctccgtg

SEQ ID NO: 13715 - DNA, 23 bp, Homo sapiens
gccaaagaaaggttgctgcttgc

SEQ ID NO: 13716 - DNA, 24 bp, Homo sapiens
ttgccgtgatgactcagtggaagg

SEQ ID NO: 13717 - DNA, 24 bp, Homo sapiens
tgaagaacaggcggctggaattgg

SEQ ID NO: 13718 - DNA, 24 bp, Homo sapiens
acacaccgactgatttggagagat

SEQ ID NO: 13719 - DNA, 23 bp, Homo sapiens
ggtgcgaatctacgatggcgagg

SEQ ID NO: 13720 - DNA, 23 bp, Homo sapiens
atctcagctcactgcgacctcca

SEQ ID NO: 13721 - DNA, 23 bp, Homo sapiens
gggttcaggcgattctcctgcct

SEQ ID NO: 13722 - DNA, 24 bp, Homo sapiens
atttagatcagagaagcattggaa

SEQ ID NO: 13723 - DNA, 24 bp, Homo sapiens
gatttagatcagagaagcattgga

SEQ ID NO: 13724 - DNA, 24 bp, Homo sapiens
tgatttagatcagagaagcattgg

SEQ ID NO: 13725 - DNA, 24 bp, Homo sapiens
agagcagccagattgtaagcaggc

SEQ ID NO: 13726 - DNA, 24 bp, Homo sapiens
gagagcagccagattgtaagcagg

SEQ ID NO: 13727 - DNA, 24 bp, Homo sapiens
ggagagcagccagattgtaagcag

SEQ ID NO: 13728 - DNA, 24 bp, Homo sapiens
acaacagcaggagcaactaagagc

SEQ ID NO: 13729 - DNA, 24 bp, Homo sapiens
agtgatggatgattctgttgttgc

SEQ ID NO: 13730 - DNA, 24 bp, Homo sapiens
gcaggtagcttatctggcgtcagt

SEQ ID NO: 13731 - DNA, 24 bp, Homo sapiens
tcagcaggagcctatggaagagat

SEQ ID NO: 13732 - DNA, 24 bp, Homo sapiens
acaacagcaggagcaactaagagc

SEQ ID NO: 13733 - DNA, 24 bp, Homo sapiens
agtgatggatgattctgttgttgc

SEQ ID NO: 13734 - DNA, 25 bp, Homo sapiens
atctgctactacaacttcctctgcg

SEQ ID NO: 13735 - DNA, 25 bp, Homo sapiens
atctgctactacaacttcctctgcg

SEQ ID NO: 13736 - DNA, 25 bp, Homo sapiens
tgccaccattgctgtcttctatgcc

SEQ ID NO: 13737 - DNA, 25 bp, Homo sapiens
atacctctatgtggctgacctggca

SEQ ID NO: 13738 - DNA, 24 bp, Homo sapiens
acacatgcaaggtgaaagggtgtg

SEQ ID NO: 13739 - DNA, 24 bp, Homo sapiens
cacacatgcaaggtgaaagggtgt

SEQ ID NO: 13740 - DNA, 24 bp, Homo sapiens
ccacacatgcaaggtgaaagggtg

SEQ ID NO: 13741 - DNA, 24 bp, Homo sapiens
tgatgccattcatgtgggagctgc

SEQ ID NO: 13742 - DNA, 24 bp, Homo sapiens
tacagtgctgcacctggctgagtg

SEQ ID NO: 13743 - DNA, 24 bp, Homo sapiens
tcttttggagctgataaagctgcc

SEQ ID NO: 13744 - DNA, 25 bp, Homo sapiens
ttaggtgctggagatggagaagtca

SEQ ID NO: 13745 - DNA, 25 bp, Homo sapiens
tttgaagaaatctatgccactgagc

SEQ ID NO: 13746 - DNA, 24 bp, Homo sapiens
ctgaacttgctggaccgctgtgat

SEQ ID NO: 13747 - DNA, 25 bp, Homo sapiens
gcattgagaaatcgggctggctatt

SEQ ID NO: 13748 - DNA, 25 bp, Homo sapiens
tttgtgtcatctgtttttagcctgt

SEQ ID NO: 13749 - DNA, 25 bp, Homo sapiens
tgatcaaggaacacagatcttctta

SEQ ID NO: 13750 - DNA, 24 bp, Homo sapiens
tctgcagcaagcctggcaccttac

SEQ ID NO: 13751 - DNA, 24 bp, Homo sapiens
gtctgcagcaagcctggcacctta

SEQ ID NO: 13752 - DNA, 24 bp, Homo sapiens
tgtctgcagcaagcctggcacctt

SEQ ID NO: 13753 - DNA, 23 bp, Homo sapiens
cgattctcccgccttagcctcct

SEQ ID NO: 13754 - DNA, 25 bp, Homo sapiens
caggctggagtgcagtggtatgatc

SEQ ID NO: 13755 - DNA, 23 bp, Homo sapiens
caaggcaacctccgcctcccagg

SEQ ID NO: 13756 - DNA, 24 bp, Homo sapiens
ggttcaagccattctcctgcctca

SEQ ID NO: 13757 - DNA, 23 bp, Homo sapiens
tgagtagctgggattacaggcgc

SEQ ID NO: 13758 - DNA, 24 bp, Homo sapiens
tccctgcccaggcctcctcagcgc

SEQ ID NO: 13759 - DNA, 24 bp, Homo sapiens
ctccctgcccaggcctcctcagcg

SEQ ID NO: 13760 - DNA, 24 bp, Homo sapiens
tctccctgcccaggcctcctcagc

SEQ ID NO: 13761 - DNA, 24 bp, Homo sapiens
tctgaaacatggtggaaaacgaag

SEQ ID NO: 13762 - DNA, 24 bp, Homo sapiens
atctgaaacatggtggaaaacgaa

SEQ ID NO: 13763 - DNA, 24 bp, Homo sapiens
catctgaaacatggtggaaaacga

SEQ ID NO: 13764 - DNA, 24 bp, Homo sapiens
tccatgtccaggttttcccatcat

SEQ ID NO: 13765 - DNA, 24 bp, Homo sapiens
ttccatgtccaggttttcccatca

SEQ ID NO: 13766 - DNA, 24 bp, Homo sapiens
cttccatgtccaggttttcccatc

SEQ ID NO: 13767 - DNA, 24 bp, Homo sapiens
ctaatgcacgtgaagcctcagcat

SEQ ID NO: 13768 - DNA, 24 bp, Homo sapiens
cctaatgcacgtgaagcctcagca

SEQ ID NO: 13769 - DNA, 24 bp, Homo sapiens
acctaatgcacgtgaagcctcagc

SEQ ID NO: 13770 - DNA, 24 bp, Homo sapiens
ggcaaccctacccatcctcactgt

SEQ ID NO: 13771 - DNA, 25 bp, Homo sapiens
ccagattcttggcagaaggtggcat

SEQ ID NO: 13772 - DNA, 25 bp, Homo sapiens
tgagagcgaatgtcgttgctgagtg

SEQ ID NO: 13773 - DNA, 25 bp, Homo sapiens
agacctcacattaagaagcctctga

SEQ ID NO: 13774 - DNA, 23 bp, Homo sapiens
caggacctcttctggagatggaa

SEQ ID NO: 13775 - DNA, 24 bp, Homo sapiens
cgacgccaaaggaacactgacatc

SEQ ID NO: 13776 - DNA, 24 bp, Homo sapiens
cctgaggtcactgctagagacgct

SEQ ID NO: 13777 - DNA, 24 bp, Homo sapiens
cctcaggtcaaacaggaacatccc

SEQ ID NO: 13778 - DNA, 23 bp, Homo sapiens
cacacaactggcatccctcatcc

SEQ ID NO: 13779 - DNA, 24 bp, Homo sapiens
ggcaaccctacccatcctcactgt

SEQ ID NO: 13780 - DNA, 25 bp, Homo sapiens
caggtacaggtccaagaatgacagc

SEQ ID NO: 13781 - DNA, 23 bp, Homo sapiens
caggacctcttctggagatggaa

SEQ ID NO: 13782 - DNA, 24 bp, Homo sapiens
cgacgccaaaggaacactgacatc

SEQ ID NO: 13783 - DNA, 23 bp, Homo sapiens
tcccatgcggtccatcctctcac

SEQ ID NO: 13784 - DNA, 24 bp, Homo sapiens
cacacccgtcacacatcccatcag

SEQ ID NO: 13785 - DNA, 25 bp, Homo sapiens
cacttacagtgacgagcacttttct

SEQ ID NO: 13786 - DNA, 25 bp, Homo sapiens
acatcaaataaagtgcccgtggtgc

SEQ ID NO: 13787 - DNA, 24 bp, Homo sapiens
cacacccgtcacacatcccatcag

SEQ ID NO: 13788 - DNA, 25 bp, Homo sapiens
ggtcagcctgtatatcccatcacgg

SEQ ID NO: 13789 - DNA, 24 bp, Homo sapiens
cacacccgtcacacatcccatcag

SEQ ID NO: 13790 - DNA, 25 bp, Homo sapiens
ggtcagcctgtatatcccatcacgg

SEQ ID NO: 13791 - DNA, 24 bp, Homo sapiens
ggcaaccctacccatcctcactgt

SEQ ID NO: 13792 - DNA, 25 bp, Homo sapiens
ggtcagcctgtatatcccatcacgg

SEQ ID NO: 13793 - DNA, 24 bp, Homo sapiens
ggcaaccctacccatcctcactgt

SEQ ID NO: 13794 - DNA, 23 bp, Homo sapiens
cacacaactggcatccctcatcc

SEQ ID NO: 13795 - DNA, 24 bp, Homo sapiens
ggcaaccctacccatcctcactgt

SEQ ID NO: 13796 - DNA, 23 bp, Homo sapiens
cacacaactggcatccctcatcc

SEQ ID NO: 13797 - DNA, 25 bp, Homo sapiens
cgtgaagcctcagcatgaacagaga

SEQ ID NO: 13798 - DNA, 25 bp, Homo sapiens
tccctcatccagctattgtaacacc

SEQ ID NO: 13799 - DNA, 23 bp, Homo sapiens
cggtcctcctggtccccacacaa

SEQ ID NO: 13800 - DNA, 23 bp, Homo sapiens
caaacaggaacatccccacactg

SEQ ID NO: 13801 - DNA, 25 bp, Homo sapiens
agacctcacattaagaagcctctga

SEQ ID NO: 13802 - DNA, 25 bp, Homo sapiens
atgagagcgaatgtcgttgctgagt

SEQ ID NO: 13803 - DNA, 23 bp, Homo sapiens
taaaagaaagtgcagctatcaac

SEQ ID NO: 13804 - DNA, 23 bp, Homo sapiens
gcgatggataacgtgcagccgaa

SEQ ID NO: 13805 - DNA, 24 bp, Homo sapiens
agttgagggaaagtgctgctgctg

SEQ ID NO: 13806 - DNA, 25 bp, Homo sapiens
gctatcgcttcgcagaacctactca

SEQ ID NO: 13807 - DNA, 23 bp, Homo sapiens
gcgatggataacgtgcagccgaa

SEQ ID NO: 13808 - DNA, 24 bp, Homo sapiens
agttgagggaaagtgctgctgctg

SEQ ID NO: 13809 - DNA, 23 bp, Homo sapiens
agaagtaggggagggcggtgctc

SEQ ID NO: 13810 - DNA, 23 bp, Homo sapiens
ggattacaggcgtgaaccactgc

SEQ ID NO: 13811 - DNA, 23 bp, Homo sapiens
tcaggtgatctgttcgcctcggc

SEQ ID NO: 13812 - DNA, 25 bp, Homo sapiens
atgttggtcaggctggtcttgaatt

SEQ ID NO: 13813 - DNA, 25 bp, Homo sapiens
agaaatcctcctgtctcagcctcct

SEQ ID NO: 13814 - DNA, 23 bp, Homo sapiens
ttgcccaggctggaatgcagtgg

SEQ ID NO: 13815 - DNA, 24 bp, Homo sapiens
cataactcactgcagcctcgaact

SEQ ID NO: 13816 - DNA, 23 bp, Homo sapiens
cttctgcctcagcctcccgagta

SEQ ID NO: 13817 - DNA, 23 bp, Homo sapiens
ttcactgcaacctccacctcccg

SEQ ID NO: 13818 - DNA, 23 bp, Homo sapiens
agcaactttcctgcctcagcctc

SEQ ID NO: 13819 - DNA, 24 bp, Homo sapiens
gtggcttcctctgatgctgacaag

SEQ ID NO: 13820 - DNA, 23 bp, Homo sapiens
gtgtccaggcacggttccttacg

SEQ ID NO: 13821 - DNA, 24 bp, Homo sapiens
ggctgccacttggttatgttgtgt

SEQ ID NO: 13822 - DNA, 23 bp, Homo sapiens
cgccagccagcctccttacaacc

SEQ ID NO: 13823 - DNA, 23 bp, Homo sapiens
gctaccacaccatgccgcctcag

SEQ ID NO: 13824 - DNA, 24 bp, Homo sapiens
tatcctcagcctccaagtgtgccg

SEQ ID NO: 13825 - DNA, 23 bp, Homo sapiens
cctcagcctccaagtgtgccgcc

SEQ ID NO: 13826 - DNA, 23 bp, Homo sapiens
gctaccacaccatgccgcctcag

SEQ ID NO: 13827 - DNA, 23 bp, Homo sapiens
tacccaccaccttacccagccca

SEQ ID NO: 13828 - DNA, 24 bp, Homo sapiens
ctctgatgctgacaaggtggggaa

SEQ ID NO: 13829 - DNA, 24 bp, Homo sapiens
cctctgatgctgacaaggtgggga

SEQ ID NO: 13830 - DNA, 24 bp, Homo sapiens
tcctctgatgctgacaaggtgggg

SEQ ID NO: 13831 - DNA, 24 bp, Homo sapiens
cttatcctcagcctccaagtgtgc

SEQ ID NO: 13832 - DNA, 24 bp, Homo sapiens
ccttatcctcagcctccaagtgtg

SEQ ID NO: 13833 - DNA, 24 bp, Homo sapiens
cccttatcctcagcctccaagtgt

SEQ ID NO: 13834 - DNA, 25 bp, Homo sapiens
accatctttgtgctgtctgtcgtca

SEQ ID NO: 13835 - DNA, 24 bp, Homo sapiens
catctgcttcacctgctcctgctg

SEQ ID NO: 13836 - DNA, 23 bp, Homo sapiens
tcaccaccaccacatccaccact

SEQ ID NO: 13837 - DNA, 23 bp, Homo sapiens
ccaccttacccagcccagcccat

SEQ ID NO: 13838 - DNA, 23 bp, Homo sapiens
gctaccacaccatgccgcctcag

SEQ ID NO: 13839 - DNA, 24 bp, Homo sapiens
tatcctcagcctccaagtgtgccg

SEQ ID NO: 13840 - DNA, 24 bp, Homo sapiens
tgtgtgtcctgcctgtatatgtgg

SEQ ID NO: 13841 - DNA, 24 bp, Homo sapiens
gtgtgtgtcctgcctgtatatgtg

SEQ ID NO: 13842 - DNA, 24 bp, Homo sapiens
tgtgtgtgtcctgcctgtatatgt

SEQ ID NO: 13843 - DNA, 24 bp, Homo sapiens
ctgctcctgctgctgcctttacaa

SEQ ID NO: 13844 - DNA, 25 bp, Homo sapiens
tgctgtctgtcgtcactatcatcat

SEQ ID NO: 13845 - DNA, 23 bp, Homo sapiens
cgccgaccacgtccggttgtcac

SEQ ID NO: 13846 - DNA, 24 bp, Homo sapiens
catctgcttcacctgctcctgctg

SEQ ID NO: 13847 - DNA, 23 bp, Homo sapiens
tcaccaccaccacatccaccact

SEQ ID NO: 13848 - DNA, 24 bp, Homo sapiens
tatcctcagcctccaagtgtgccg

SEQ ID NO: 13849 - DNA, 24 bp, Homo sapiens
catctgcttcacctgctcctgctg

SEQ ID NO: 13850 - DNA, 25 bp, Homo sapiens
accatctttgtgctgtctgtcgtca

SEQ ID NO: 13851 - DNA, 24 bp, Homo sapiens
ctcactacagccttgaactcctgg

SEQ ID NO: 13852 - DNA, 24 bp, Homo sapiens
agtgatcctcctgcttggacctcc

SEQ ID NO: 13853 - DNA, 24 bp, Homo sapiens
ctccctcctcagcctcccaagtag

SEQ ID NO: 13854 - DNA, 24 bp, Homo sapiens
gcctcccaaaatgctgggattaca

SEQ ID NO: 13855 - DNA, 24 bp, Homo sapiens
agcctcccaaaatgctgggattac

SEQ ID NO: 13856 - DNA, 24 bp, Homo sapiens
cagcctcccaaaatgctgggatta

SEQ ID NO: 13857 - DNA, 24 bp, Homo sapiens
tcagcctcccaaaatgctgggatt

SEQ ID NO: 13858 - DNA, 24 bp, Homo sapiens
ctcagcctcccaaaatgctgggat

SEQ ID NO: 13859 - DNA, 24 bp, Homo sapiens
cctcagcctcccaaaatgctggga

SEQ ID NO: 13860 - DNA, 23 bp, Homo sapiens
atcctcccacctcagcctccaga

SEQ ID NO: 13861 - DNA, 25 bp, Homo sapiens
cactatgttgtccaagctggtctca

SEQ ID NO: 13862 - DNA, 23 bp, Homo sapiens
tcaagccatcctcccacctcagc

SEQ ID NO: 13863 - DNA, 23 bp, Homo sapiens
ttgtgcttggtgctgctgatagg

SEQ ID NO: 13864 - DNA, 23 bp, Homo sapiens
cctcttcaacgtggcgaccagtg

SEQ ID NO: 13865 - DNA, 24 bp, Homo sapiens
gacaccaccatgagcctgcattct

SEQ ID NO: 13866 - DNA, 24 bp, Homo sapiens
tggcttaatcatggctcacggcaa

SEQ ID NO: 13867 - DNA, 23 bp, Homo sapiens
tcaagccatcctcccacctcagc

SEQ ID NO: 13868 - DNA, 24 bp, Homo sapiens
ctgtctcagtgtcatacccatcta

SEQ ID NO: 13869 - DNA, 24 bp, Homo sapiens
cctgtctcagtgtcatacccatct

SEQ ID NO: 13870 - DNA, 24 bp, Homo sapiens
ccctgtctcagtgtcatacccatc

SEQ ID NO: 13871 - DNA, 24 bp, Homo sapiens
tacacaagtcacctccagcagcct

SEQ ID NO: 13872 - DNA, 24 bp, Homo sapiens
gtcgcacggaatacagatggagcc

SEQ ID NO: 13873 - DNA, 25 bp, Homo sapiens
gtcatctactccacaccattgcctg

SEQ ID NO: 13874 - DNA, 24 bp, Homo sapiens
tacacaagtcacctccagcagcct

SEQ ID NO: 13875 - DNA, 23 bp, Homo sapiens
tgccttcttccagcccaccgata

SEQ ID NO: 13876 - DNA, 23 bp, Homo sapiens
gccctcctctctgaagttcccgt

SEQ ID NO: 13877 - DNA, 24 bp, Homo sapiens
tacacaagtcacctccagcagcct

SEQ ID NO: 13878 - DNA, 23 bp, Homo sapiens
cgctgtccatgccaccagtgatg

SEQ ID NO: 13879 - DNA, 23 bp, Homo sapiens
tgccttcttccagcccaccgata

SEQ ID NO: 13880 - DNA, 24 bp, Homo sapiens
gggaggctgaggcaggagaatcac

SEQ ID NO: 13881 - DNA, 24 bp, Homo sapiens
cgggaggctgaggcaggagaatca

SEQ ID NO: 13882 - DNA, 24 bp, Homo sapiens
tcgggaggctgaggcaggagaatc

SEQ ID NO: 13883 - DNA, 23 bp, Homo sapiens
ggttcaggcaacacctcctcagc

SEQ ID NO: 13884 - DNA, 23 bp, Homo sapiens
gaccgccatcaacagtcagaagg

SEQ ID NO: 13885 - DNA, 23 bp, Homo sapiens
caactgcgaccatgcctgcctct

SEQ ID NO: 13886 - DNA, 25 bp, Homo sapiens
ccagtagttaagcaaggaccagtgt

SEQ ID NO: 13887 - DNA, 24 bp, Homo sapiens
tctccaagaataagcacacctcaa

SEQ ID NO: 13888 - DNA, 24 bp, Homo sapiens
ccagccatctaatcagtctccgat

SEQ ID NO: 13889 - DNA, 23 bp, Homo sapiens
ctcctgaccacaagtgatccgcc

SEQ ID NO: 13890 - DNA, 25 bp, Homo sapiens
agtagaggcagagtttcaccatgtt

SEQ ID NO: 13891 - DNA, 25 bp, Homo sapiens
cctcaacctgccaagtagctaggat

SEQ ID NO: 13892 - DNA, 24 bp, Homo sapiens
gtgctggtggcctttcccccgtgg

SEQ ID NO: 13893 - DNA, 24 bp, Homo sapiens
ggtgctggtggcctttcccccgtg

SEQ ID NO: 13894 - DNA, 24 bp, Homo sapiens
gggtgctggtggcctttcccccgt

SEQ ID NO: 13895 - DNA, 24 bp, Homo sapiens
gtggcccgcaggtgagccccagca

SEQ ID NO: 13896 - DNA, 24 bp, Homo sapiens
tgtggcccgcaggtgagccccagc

SEQ ID NO: 13897 - DNA, 24 bp, Homo sapiens
atgtggcccgcaggtgagccccag

SEQ ID NO: 13898 - DNA, 23 bp, Homo sapiens
agcgattctcctgcctcagcctc

SEQ ID NO: 13899 - DNA, 23 bp, Homo sapiens
ctcaccgcaacctcagcctcccg

SEQ ID NO: 13900 - DNA, 23 bp, Homo sapiens
caggctggagtgcaatggctcaa

SEQ ID NO: 13901 - DNA, 24 bp, Homo sapiens
ggttggcaatgatgctgtcttcct

SEQ ID NO: 13902 - DNA, 24 bp, Homo sapiens
aggttggcaatgatgctgtcttcc

SEQ ID NO: 13903 - DNA, 24 bp, Homo sapiens
caggttggcaatgatgctgtcttc

SEQ ID NO: 13904 - DNA, 24 bp, Homo sapiens
gccagtcgtgtctccagtgatgtc

SEQ ID NO: 13905 - DNA, 25 bp, Homo sapiens
caggaccttgcttatgaacgtcagt

SEQ ID NO: 13906 - DNA, 25 bp, Homo sapiens
actgtctcagatttgattgaccaga

SEQ ID NO: 13907 - DNA, 25 bp, Homo sapiens
cagaaggtgtatgagatccaggaca

SEQ ID NO: 13908 - DNA, 24 bp, Homo sapiens
gccagtcgtgtctccagtgatgtc

SEQ ID NO: 13909 - DNA, 23 bp, Homo sapiens
gcacacaggagatccaaagcagg

SEQ ID NO: 13910 - DNA, 25 bp, Homo sapiens
ttgaccagaaggtgtatgagatcca

SEQ ID NO: 13911 - DNA, 24 bp, Homo sapiens
ctacaggccagtcgtgtctccagt

SEQ ID NO: 13912 - DNA, 24 bp, Homo sapiens
tgaccagaaggtgtatgagatcca

SEQ ID NO: 13913 - DNA, 23 bp, Homo sapiens
caggccagtcgtgtctccagtga

SEQ ID NO: 13914 - DNA, 25 bp, Homo sapiens
cgtcagtatgaacagcaaacctatc

SEQ ID NO: 13915 - DNA, 23 bp, Homo sapiens
gctcaccacaacctctgccttcc

SEQ ID NO: 13916 - DNA, 23 bp, Homo sapiens
atccgcccacctcagccttccat

SEQ ID NO: 13917 - DNA, 25 bp, Homo sapiens
agagacagggtttcaccatattggc

SEQ ID NO: 13918 - DNA, 24 bp, Homo sapiens
gctcttggctggtgttgatagatt

SEQ ID NO: 13919 - DNA, 24 bp, Homo sapiens
tgctcttggctggtgttgatagat

SEQ ID NO: 13920 - DNA, 24 bp, Homo sapiens
ctgctcttggctggtgttgataga

SEQ ID NO: 13921 - DNA, 23 bp, Homo sapiens
acattggctccttctcagtccgc

SEQ ID NO: 13922 - DNA, 23 bp, Homo sapiens
cgtctacggcggagatgaggtgg

SEQ ID NO: 13923 - DNA, 23 bp, Homo sapiens
ctagcagcgcagcgggcactatg

SEQ ID NO: 13924 - DNA, 25 bp, Homo sapiens
tgatcttctgcttaggatgggactt

SEQ ID NO: 13925 - DNA, 25 bp, Homo sapiens
aagcaggaatggaaggattagataa

SEQ ID NO: 13926 - DNA, 25 bp, Homo sapiens
agcacaaaggagaagtgtgacagtt

SEQ ID NO: 13927 - DNA, 25 bp, Homo sapiens
tgagggacaatccagaattgaagga

SEQ ID NO: 13928 - DNA, 25 bp, Homo sapiens
acattgacatggatgctttctatgc

SEQ ID NO: 13929 - DNA, 24 bp, Homo sapiens
aaagccgaaatttgagcaatacca

SEQ ID NO: 13930 - DNA, 24 bp, Homo sapiens
acagtggtccagccttcattagcc

SEQ ID NO: 13931 - DNA, 24 bp, Homo sapiens
cagacaccagtcctccaacaggct

SEQ ID NO: 13932 - DNA, 24 bp, Homo sapiens
gactgttctcctaccacttgtgct

SEQ ID NO: 13933 - DNA, 23 bp, Homo sapiens
ttcctggatttgcgaaacctggc

SEQ ID NO: 13934 - DNA, 25 bp, Homo sapiens
acagtcgtgctagttcctcatccat

SEQ ID NO: 13935 - DNA, 25 bp, Homo sapiens
agcaactggtgatgatgatgactgg

SEQ ID NO: 13936 - DNA, 23 bp, Homo sapiens
cgaggggcggtgggggtggacag

SEQ ID NO: 13937 - DNA, 25 bp, Homo sapiens
aggtagcgtggaatcgcttagaagc

SEQ ID NO: 13938 - DNA, 23 bp, Homo sapiens
cgggaaggagggcgcggggctgc

SEQ ID NO: 13939 - DNA, 23 bp, Homo sapiens
caattctcctgcctcaacctcct

SEQ ID NO: 13940 - DNA, 23 bp, Homo sapiens
ggctggagtgcaatggcacgatc

SEQ ID NO: 13941 - DNA, 23 bp, Homo sapiens
cactgccacctccgcctcccggg

SEQ ID NO: 13942 - DNA, 24 bp, Homo sapiens
agcaatacttccacctcagcctcc

SEQ ID NO: 13943 - DNA, 25 bp, Homo sapiens
cctggttcaagtgattctcctgcct

SEQ ID NO: 13944 - DNA, 23 bp, Homo sapiens
agatggagtcttgctctgtcgcc

SEQ ID NO: 13945 - DNA, 24 bp, Homo sapiens
attctgtccagaaccccgtctgtg

SEQ ID NO: 13946 - DNA, 24 bp, Homo sapiens
gattctgtccagaaccccgtctgt

SEQ ID NO: 13947 - DNA, 24 bp, Homo sapiens
cgattctgtccagaaccccgtctg

SEQ ID NO: 13948 - DNA, 24 bp, Homo sapiens
attctgtccaggtgagctgcccca

SEQ ID NO: 13949 - DNA, 24 bp, Homo sapiens
gattctgtccaggtgagctgcccc

SEQ ID NO: 13950 - DNA, 24 bp, Homo sapiens
cgattctgtccaggtgagctgccc

SEQ ID NO: 13951 - DNA, 24 bp, Homo sapiens
atccagagaagacaagtgatggag

SEQ ID NO: 13952 - DNA, 24 bp, Homo sapiens
catccagagaagacaagtgatgga

SEQ ID NO: 13953 - DNA, 24 bp, Homo sapiens
acatccagagaagacaagtgatgg

SEQ ID NO: 13954 - DNA, 24 bp, Homo sapiens
taactcctcagaggctggccggaa

SEQ ID NO: 13955 - DNA, 24 bp, Homo sapiens
ctaactcctcagaggctggccgga

SEQ ID NO: 13956 - DNA, 24 bp, Homo sapiens
cctaactcctcagaggctggccgg

SEQ ID NO: 13957 - DNA, 23 bp, Homo sapiens
gccacgccaaccttccaccagtg

SEQ ID NO: 13958 - DNA, 24 bp, Homo sapiens
gcaagtaaagaagaggcaaccacg

SEQ ID NO: 13959 - DNA, 23 bp, Homo sapiens
cagccagcgtcaggtgcagaatg

SEQ ID NO: 13960 - DNA, 24 bp, Homo sapiens
gattctgcctgacacggaacacca

SEQ ID NO: 13961 - DNA, 25 bp, Homo sapiens
tgttttatatttgcttatttaaggt

SEQ ID NO: 13962 - DNA, 23 bp, Homo sapiens
gccagcaacaccttcagagtcgt

SEQ ID NO: 13963 - DNA, 25 bp, Homo sapiens
ggcttccgtgatggtctacgatgac

SEQ ID NO: 13964 - DNA, 25 bp, Homo sapiens
ggattcagccggatcaacatctacc

SEQ ID NO: 13965 - DNA, 24 bp, Homo sapiens
caaaagaggatgtatgagcagcag

SEQ ID NO: 13966 - DNA, 24 bp, Homo sapiens
gcaaaagaggatgtatgagcagca

SEQ ID NO: 13967 - DNA, 24 bp, Homo sapiens
agcaaaagaggatgtatgagcagc

SEQ ID NO: 13968 - DNA, 24 bp, Homo sapiens
gccgcctgcaggtgagtgcgcccc

SEQ ID NO: 13969 - DNA, 24 bp, Homo sapiens
cgccgcctgcaggtgagtgcgccc

SEQ ID NO: 13970 - DNA, 24 bp, Homo sapiens
gcgccgcctgcaggtgagtgcgcc

SEQ ID NO: 13971 - DNA, 23 bp, Homo sapiens
gcactcggtgaagacaggtggtg

SEQ ID NO: 13972 - DNA, 25 bp, Homo sapiens
cttccaagtgtcggatcagcaagat

SEQ ID NO: 13973 - DNA, 25 bp, Homo sapiens
ggtcgccgtccttgcaattagtaga

SEQ ID NO: 13974 - DNA, 24 bp, Homo sapiens
gctgcgaggagtgtaaacaggaac

SEQ ID NO: 13975 - DNA, 24 bp, Homo sapiens
agctgcgaggagtgtaaacaggaa

SEQ ID NO: 13976 - DNA, 24 bp, Homo sapiens
cagctgcgaggagtgtaaacagga

SEQ ID NO: 13977 - DNA, 23 bp, Homo sapiens
acgctttctggtggtctgggagt

SEQ ID NO: 13978 - DNA, 25 bp, Homo sapiens
ttggagattgttcaacttcacgagt

SEQ ID NO: 13979 - DNA, 25 bp, Homo sapiens
tgcctggtgtgatttgactttaact

SEQ ID NO: 13980 - DNA, 24 bp, Homo sapiens
gtctgttttaggatggctacaata

SEQ ID NO: 13981 - DNA, 24 bp, Homo sapiens
tgtctgttttaggatggctacaat

SEQ ID NO: 13982 - DNA, 24 bp, Homo sapiens
ttgtctgttttaggatggctacaa

SEQ ID NO: 13983 - DNA, 25 bp, Homo sapiens
acacatctgtactcgtcaatcaaca

SEQ ID NO: 13984 - DNA, 25 bp, Homo sapiens
aggagatggtcaggttggtaggaga

SEQ ID NO: 13985 - DNA, 25 bp, Homo sapiens
gcgaacagtaggtagcaagggagtg

SEQ ID NO: 13986 - DNA, 23 bp, Homo sapiens
cttcaagcgattctcctgcctca

SEQ ID NO: 13987 - DNA, 24 bp, Homo sapiens
gtggcgcgatcttggcttactaca

SEQ ID NO: 13988 - DNA, 24 bp, Homo sapiens
ccctgcccacgagcctgccctcgc

SEQ ID NO: 13989 - DNA, 24 bp, Homo sapiens
cccctgcccacgagcctgccctcg

SEQ ID NO: 13990 - DNA, 24 bp, Homo sapiens
tcccctgcccacgagcctgccctc

SEQ ID NO: 13991 - DNA, 24 bp, Homo sapiens
tatctgcggctgtatgtgcacacc

SEQ ID NO: 13992 - DNA, 24 bp, Homo sapiens
gtatctgcggctgtatgtgcacac

SEQ ID NO: 13993 - DNA, 24 bp, Homo sapiens
ggtatctgcggctgtatgtgcaca

SEQ ID NO: 13994 - DNA, 25 bp, Homo sapiens
gagccgagtctatgtggacatcacc

SEQ ID NO: 13995 - DNA, 25 bp, Homo sapiens
caggacaacgagacattagaggtgc

SEQ ID NO: 13996 - DNA, 23 bp, Homo sapiens
cccgaccactacatatcaggacg

SEQ ID NO: 13997 - DNA, 25 bp, Homo sapiens
atctatgacttgcttgacaccgcca

SEQ ID NO: 13998 - DNA, 24 bp, Homo sapiens
cctggtatctgcggctgtatgtgc

SEQ ID NO: 13999 - DNA, 25 bp, Homo sapiens
aagttacatccactaccagcctgcc

SEQ ID NO: 14000 - DNA, 24 bp, Homo sapiens
gcccttctcagccctgtactggtt

SEQ ID NO: 14001 - DNA, 24 bp, Homo sapiens
tgcccttctcagccctgtactggt

SEQ ID NO: 14002 - DNA, 24 bp, Homo sapiens
gtgcccttctcagccctgtactgg

SEQ ID NO: 14003 - DNA, 25 bp, Homo sapiens
accgccatctacttcactgcctatg

SEQ ID NO: 14004 - DNA, 24 bp, Homo sapiens
cctgacctctgacctctacgcacc

SEQ ID NO: 14005 - DNA, 23 bp, Homo sapiens
caggctcagcatgtgtcgtaccg

SEQ ID NO: 14006 - DNA, 24 bp, Homo sapiens
gcttcaagatggctgaccaggacc

SEQ ID NO: 14007 - DNA, 23 bp, Homo sapiens
cctccagcaaatggtggcctcag

SEQ ID NO: 14008 - DNA, 24 bp, Homo sapiens
agagtggtgtggatgcagactctt

SEQ ID NO: 14009 - DNA, 24 bp, Homo sapiens
aagagtggtgtggatgcagactct

SEQ ID NO: 14010 - DNA, 24 bp, Homo sapiens
taagagtggtgtggatgcagactc

SEQ ID NO: 14011 - DNA, 23 bp, Homo sapiens
gtggtgtgggtgactggagcctc

SEQ ID NO: 14012 - DNA, 24 bp, Homo sapiens
tgtcagccagaagagtgcatgagc

SEQ ID NO: 14013 - DNA, 24 bp, Homo sapiens
cttgacctgaccgacactggttcc

SEQ ID NO: 14014 - DNA, 24 bp, Homo sapiens
ccttgacctgaccgacactggttc

SEQ ID NO: 14015 - DNA, 24 bp, Homo sapiens
tgtcagccagaagagtgcatgagc

SEQ ID NO: 14016 - DNA, 23 bp, Homo sapiens
tggaattggtgaggagctggctt

SEQ ID NO: 14017 - DNA, 23 bp, Homo sapiens
gtggtgtgggtgactggagcctc

SEQ ID NO: 14018 - DNA, 23 bp, Homo sapiens
aattggtgaggagctggcttacc

SEQ ID NO: 14019 - DNA, 25 bp, Homo sapiens
agaagagtgcatgagctggaaaggg

SEQ ID NO: 14020 - DNA, 24 bp, Homo sapiens
tgtcagccagaagagtgcatgagc

SEQ ID NO: 14021 - DNA, 23 bp, Homo sapiens
tggaattggtgaggagctggctt

SEQ ID NO: 14022 - DNA, 24 bp, Homo sapiens
tatggtggtgtgggtgactggagc

SEQ ID NO: 14023 - DNA, 24 bp, Homo sapiens
gcaatggcatgatctcggctcact

SEQ ID NO: 14024 - DNA, 23 bp, Homo sapiens
caattctcctgcctcagcctccc

SEQ ID NO: 14025 - DNA, 23 bp, Homo sapiens
ggctgtttggaaagacccaggag

SEQ ID NO: 14026 - DNA, 23 bp, Homo sapiens
aggggcaagacgggttcagttcg

SEQ ID NO: 14027 - DNA, 23 bp, Homo sapiens
tgcctgggcgcggggaactgaaa

SEQ ID NO: 14028 - DNA, 24 bp, Homo sapiens
caaagaactggtcaatgagtggtc

SEQ ID NO: 14029 - DNA, 25 bp, Homo sapiens
ggctgtttggaaagacccaggagaa

SEQ ID NO: 14030 - DNA, 23 bp, Homo sapiens
aaggggcaagacgggttcagttc

SEQ ID NO: 14031 - DNA, 25 bp, Homo sapiens
gcaatactaccaacaaccaacagca

SEQ ID NO: 14032 - DNA, 23 bp, Homo sapiens
aaaccagccacaccaagtccagc

SEQ ID NO: 14033 - DNA, 25 bp, Homo sapiens
ccatctatcctgtatcctccaccgt

SEQ ID NO: 14034 - DNA, 25 bp, Homo sapiens
actggcgaagacgagaagaagagga

SEQ ID NO: 14035 - DNA, 25 bp, Homo sapiens
gccatgattatgtggaagaggtacg

SEQ ID NO: 14036 - DNA, 25 bp, Homo sapiens
cttgctgctttacagagtgatgtgc

SEQ ID NO: 14037 - DNA, 24 bp, Homo sapiens
gctgggactacaggcatgaaccac

SEQ ID NO: 14038 - DNA, 24 bp, Homo sapiens
aagtgatctacctgcctcggcctc

SEQ ID NO: 14039 - DNA, 24 bp, Homo sapiens
ttgcccaggctggtctcaaactcc

SEQ ID NO: 14040 - DNA, 23 bp, Homo sapiens
caggctggactcgaacctctgag

SEQ ID NO: 14041 - DNA, 24 bp, Homo sapiens
ctgggattacaggcatgagcactg

SEQ ID NO: 14042 - DNA, 23 bp, Homo sapiens
tgatcctccccactcggtctccc

SEQ ID NO: 14043 - DNA, 24 bp, Homo sapiens
atgatgctgagaacctaggcaaag

SEQ ID NO: 14044 - DNA, 24 bp, Homo sapiens
tatgatgctgagaacctaggcaaa

SEQ ID NO: 14045 - DNA, 24 bp, Homo sapiens
atatgatgctgagaacctaggcaa

SEQ ID NO: 14046 - DNA, 24 bp, Homo sapiens
cggcgttgatctgcatcctgacat

SEQ ID NO: 14047 - DNA, 25 bp, Homo sapiens
ccatcttcttgtggctgatcaccag

SEQ ID NO: 14048 - DNA, 25 bp, Homo sapiens
ccgtcttacctcttcttgacctgaa

SEQ ID NO: 14049 - DNA, 24 bp, Homo sapiens
cggcgttgatctgcatcctgacat

SEQ ID NO: 14050 - DNA, 25 bp, Homo sapiens
ccgtcttacctcttcttgacctgaa

SEQ ID NO: 14051 - DNA, 23 bp, Homo sapiens
attgagggaggagcacggaaggg

SEQ ID NO: 14052 - DNA, 24 bp, Homo sapiens
ttgtgatcaaggcaacacctgagc

SEQ ID NO: 14053 - DNA, 24 bp, Homo sapiens
attgtgatcaaggcaacacctgag

SEQ ID NO: 14054 - DNA, 24 bp, Homo sapiens
cattgtgatcaaggcaacacctga

SEQ ID NO: 14055 - DNA, 24 bp, Homo sapiens
atgggcaagagcttgactcatggt

SEQ ID NO: 14056 - DNA, 24 bp, Homo sapiens
gatgggcaagagcttgactcatgg

SEQ ID NO: 14057 - DNA, 24 bp, Homo sapiens
agatgggcaagagcttgactcatg

SEQ ID NO: 14058 - DNA, 25 bp, Homo sapiens
cttctctcagtagcaacctcgtggc

SEQ ID NO: 14059 - DNA, 25 bp, Homo sapiens
cgaagattgtaactcagcctcagag

SEQ ID NO: 14060 - DNA, 25 bp, Homo sapiens
aaggacgataggtatagggagccac

SEQ ID NO: 14061 - DNA, 25 bp, Homo sapiens
ttaatagaagaacattccatcgtgg

SEQ ID NO: 14062 - DNA, 23 bp, Homo sapiens
tcttgaaagtcctttggatgttg

SEQ ID NO: 14063 - DNA, 23 bp, Homo sapiens
aactattggaatggtttaagatc

SEQ ID NO: 14064 - DNA, 24 bp, Homo sapiens
cgccattctatccagcatgtgcca

SEQ ID NO: 14065 - DNA, 25 bp, Homo sapiens
cctaagccaatcacaagatgacagc

SEQ ID NO: 14066 - DNA, 25 bp, Homo sapiens
caaggcactgtaggcatagtctggc

SEQ ID NO: 14067 - DNA, 24 bp, Homo sapiens
cgccattctatccagcatgtgcca

SEQ ID NO: 14068 - DNA, 25 bp, Homo sapiens
gcctaagccaatcacaagatgacag

SEQ ID NO: 14069 - DNA, 25 bp, Homo sapiens
caaggcactgtaggcatagtctggc

SEQ ID NO: 14070 - DNA, 25 bp, Homo sapiens
tgtctccagtgcctatgaggtcagc

SEQ ID NO: 14071 - DNA, 25 bp, Homo sapiens
agtggtaagaagcatacagaagaca

SEQ ID NO: 14072 - DNA, 25 bp, Homo sapiens
acttgtctgactccagccatagtga

SEQ ID NO: 14073 - DNA, 24 bp, Homo sapiens
ttcctgcattggtgagtagcttca

SEQ ID NO: 14074 - DNA, 24 bp, Homo sapiens
tttcctgcattggtgagtagcttc

SEQ ID NO: 14075 - DNA, 24 bp, Homo sapiens
gtttcctgcattggtgagtagctt

SEQ ID NO: 14076 - DNA, 24 bp, Homo sapiens
agcttactgcaatctccgtctcct

SEQ ID NO: 14077 - DNA, 23 bp, Homo sapiens
aagcagttctgcctcagcctcct

SEQ ID NO: 14078 - DNA, 25 bp, Homo sapiens
actgagacgatcttcactgtgcctg

SEQ ID NO: 14079 - DNA, 25 bp, Homo sapiens
agcagtgaagcagaggaagaagagg

SEQ ID NO: 14080 - DNA, 25 bp, Homo sapiens
actggaagactgaattgaaagaaga

SEQ ID NO: 14081 - DNA, 25 bp, Homo sapiens
agatgatgaaaaagaaaaggaggat

SEQ ID NO: 14082 - DNA, 25 bp, Homo sapiens
actgcggatggaatgtgagatacga

SEQ ID NO: 14083 - DNA, 24 bp, Homo sapiens
caagtgcggtatggacgagggaaa

SEQ ID NO: 14084 - DNA, 25 bp, Homo sapiens
tgatgacaacaatgaggaagaggag

SEQ ID NO: 14085 - DNA, 24 bp, Homo sapiens
cagtcattacggtcacaatgacga

SEQ ID NO: 14086 - DNA, 24 bp, Homo sapiens
acagtcattacggtcacaatgacg

SEQ ID NO: 14087 - DNA, 24 bp, Homo sapiens
aacagtcattacggtcacaatgac

SEQ ID NO: 14088 - DNA, 24 bp, Homo sapiens
gacagtcagagtcattcttgcccc

SEQ ID NO: 14089 - DNA, 24 bp, Homo sapiens
tgacagtcagagtcattcttgccc

SEQ ID NO: 14090 - DNA, 24 bp, Homo sapiens
ctgacagtcagagtcattcttgcc

SEQ ID NO: 14091 - DNA, 24 bp, Homo sapiens
aaggacatccatgttccgagaaga

SEQ ID NO: 14092 - DNA, 24 bp, Homo sapiens
ccctgtatttcaagacctctgtgc

SEQ ID NO: 14093 - DNA, 24 bp, Homo sapiens
acagaacacagcaattcctcaggc

SEQ ID NO: 14094 - DNA, 24 bp, Homo sapiens
ttgatggaacttagacagcaaggc

SEQ ID NO: 14095 - DNA, 24 bp, Homo sapiens
aaggacatccatgttccgagaaga

SEQ ID NO: 14096 - DNA, 24 bp, Homo sapiens
ccctgtatttcaagacctctgtgc

SEQ ID NO: 14097 - DNA, 24 bp, Homo sapiens
ccctgtatttcaagacctctgtgc

SEQ ID NO: 14098 - DNA, 24 bp, Homo sapiens
ctagaacggaaggctcccttgatg

SEQ ID NO: 14099 - DNA, 24 bp, Homo sapiens
agacagcaaggccagatgcacatc

SEQ ID NO: 14100 - DNA, 24 bp, Homo sapiens
cagataattgccattcccacgcca

SEQ ID NO: 14101 - DNA, 24 bp, Homo sapiens
gacagaccatcgaagtccgttgcg

SEQ ID NO: 14102 - DNA, 24 bp, Homo sapiens
ccaagaactcaaatgatcctgcgg

SEQ ID NO: 14103 - DNA, 24 bp, Homo sapiens
ttgatggaacttagacagcaaggc

SEQ ID NO: 14104 - DNA, 24 bp, Homo sapiens
acagaacacagcaattcctcaggc

SEQ ID NO: 14105 - DNA, 24 bp, Homo sapiens
ccacatacactccttccaccaagt

SEQ ID NO: 14106 - DNA, 24 bp, Homo sapiens
cccaggggctggaggccttttcct

SEQ ID NO: 14107 - DNA, 24 bp, Homo sapiens
gcccaggggctggaggccttttcc

SEQ ID NO: 14108 - DNA, 24 bp, Homo sapiens
ggcccaggggctggaggccttttc

SEQ ID NO: 14109 - DNA, 23 bp, Homo sapiens
agtcctttccgctcctttgccag

SEQ ID NO: 14110 - DNA, 24 bp, Homo sapiens
gctcttccacttccatgttcctga

SEQ ID NO: 14111 - DNA, 25 bp, Homo sapiens
tggaacctcatcatcttcaaggagc

SEQ ID NO: 14112 - DNA, 25 bp, Homo sapiens
ggaacctcatcatcttcaaggagca

SEQ ID NO: 14113 - DNA, 23 bp, Homo sapiens
actgcccagaccaaagtgtgact

SEQ ID NO: 14114 - DNA, 24 bp, Homo sapiens
accgcacctcaggcatctttaacg

SEQ ID NO: 14115 - DNA, 23 bp, Homo sapiens
gtcactgcgtctgcgtcccaaag

SEQ ID NO: 14116 - DNA, 23 bp, Homo sapiens
ctgtggaggtgcctcaggatgcc

SEQ ID NO: 14117 - DNA, 23 bp, Homo sapiens
cacttacagggtttcagcacagc

SEQ ID NO: 14118 - DNA, 24 bp, Homo sapiens
tctgaagagagtcgcccttacaca

SEQ ID NO: 14119 - DNA, 24 bp, Homo sapiens
ctctgaagagagtcgcccttacac

SEQ ID NO: 14120 - DNA, 24 bp, Homo sapiens
actctgaagagagtcgcccttaca

SEQ ID NO: 14121 - DNA, 25 bp, Homo sapiens
tggacttgctcggctctataactct

SEQ ID NO: 14122 - DNA, 25 bp, Homo sapiens
agtcgcccttacacaaacaaagtca

SEQ ID NO: 14123 - DNA, 25 bp, Homo sapiens
accgacctccagaactactgctagg

SEQ ID NO: 14124 - DNA, 24 bp, Homo sapiens
tcatgatgaagaggtactcaagac

SEQ ID NO: 14125 - DNA, 24 bp, Homo sapiens
ctcatgatgaagaggtactcaaga

SEQ ID NO: 14126 - DNA, 24 bp, Homo sapiens
gctcatgatgaagaggtactcaag

SEQ ID NO: 14127 - DNA, 24 bp, Homo sapiens
gcaccagtaacaactccagagccg

SEQ ID NO: 14128 - DNA, 23 bp, Homo sapiens
cccaaagccgacagcactgacat

SEQ ID NO: 14129 - DNA, 25 bp, Homo sapiens
acagacagttcggcatcaaatagca

SEQ ID NO: 14130 - DNA, 24 bp, Homo sapiens
atgtagagaagacagctgaggatg

SEQ ID NO: 14131 - DNA, 24 bp, Homo sapiens
tatgtagagaagacagctgaggat

SEQ ID NO: 14132 - DNA, 24 bp, Homo sapiens
ctatgtagagaagacagctgagga

SEQ ID NO: 14133 - DNA, 24 bp, Homo sapiens
tcccctcacagactgcatacgagg

SEQ ID NO: 14134 - DNA, 24 bp, Homo sapiens
atcccctcacagactgcatacgag

SEQ ID NO: 14135 - DNA, 24 bp, Homo sapiens
catcccctcacagactgcatacga

SEQ ID NO: 14136 - DNA, 24 bp, Homo sapiens
cgcaccaggcggatgccccagccg

SEQ ID NO: 14137 - DNA, 24 bp, Homo sapiens
cgggcggcggcagcggccaggtgc

SEQ ID NO: 14138 - DNA, 22 bp, Homo sapiens
tgaccctgcgacccactctttg

SEQ ID NO: 14139 - DNA, 26 bp, Homo sapiens
gcggatgaataaagcttcctgtgttg

SEQ ID NO: 14140 - DNA, 24 bp, Homo sapiens
ggtggaacgcctacatcgacaacc

SEQ ID NO: 14141 - DNA, 24 bp, Homo sapiens
gggtggaacgcctacatcgacaac

SEQ ID NO: 14142 - DNA, 24 bp, Homo sapiens
cgggtggaacgcctacatcgacaa

SEQ ID NO: 14143 - DNA, 24 bp, Homo sapiens
gtggaacgcctacatcgacaacct

SEQ ID NO: 14144 - DNA, 24 bp, Homo sapiens
ctacaaggactcgccctccgtctg

SEQ ID NO: 14145 - DNA, 24 bp, Homo sapiens
ggtgggtgtcctggttggcaaaga

SEQ ID NO: 14146 - DNA, 24 bp, Homo sapiens
cacaaggaccgtttcatttcaggg

SEQ ID NO: 14147 - DNA, 24 bp, Homo sapiens
ccacaaggaccgtttcatttcagg

SEQ ID NO: 14148 - DNA, 24 bp, Homo sapiens
gccacaaggaccgtttcatttcag

SEQ ID NO: 14149 - DNA, 23 bp, Homo sapiens
gccgctctggtgcctcctcactt

SEQ ID NO: 14150 - DNA, 25 bp, Homo sapiens
ctttgggagggtcaagatgtgctgg

SEQ ID NO: 14151 - DNA, 25 bp, Homo sapiens
ggactgatgggctgctatacttggg

SEQ ID NO: 14152 - DNA, 23 bp, Homo sapiens
gaggccggagccagagcccctga

SEQ ID NO: 14153 - DNA, 23 bp, Homo sapiens
gcagaaggggaaagtggaggagc

SEQ ID NO: 14154 - DNA, 23 bp, Homo sapiens
accctcagcagtgcgcaatcagc

SEQ ID NO: 14155 - DNA, 23 bp, Homo sapiens
tcctcctgccgctgccgctgctt

SEQ ID NO: 14156 - DNA, 23 bp, Homo sapiens
ggtctcctacgtctgcccctgcc

SEQ ID NO: 14157 - DNA, 23 bp, Homo sapiens
cccacgcccggacgtgccctctc

SEQ ID NO: 14158 - DNA, 24 bp, Homo sapiens
tatggggacagggtggatgtggcc

SEQ ID NO: 14159 - DNA, 24 bp, Homo sapiens
ctatggggacagggtggatgtggc

SEQ ID NO: 14160 - DNA, 24 bp, Homo sapiens
tctatggggacagggtggatgtgg

SEQ ID NO: 14161 - DNA, 24 bp, Homo sapiens
aaaactcctggctgatgaacttat

SEQ ID NO: 14162 - DNA, 24 bp, Homo sapiens
caaaactcctggctgatgaactta

SEQ ID NO: 14163 - DNA, 24 bp, Homo sapiens
gcaaaactcctggctgatgaactt

SEQ ID NO: 14164 - DNA, 24 bp, Homo sapiens
gtgtttgacctgatgcggaaggga

SEQ ID NO: 14165 - DNA, 24 bp, Homo sapiens
ggtgtttgacctgatgcggaaggg

SEQ ID NO: 14166 - DNA, 24 bp, Homo sapiens
tggtgtttgacctgatgcggaagg

SEQ ID NO: 14167 - DNA, 24 bp, Homo sapiens
ctgtggtccgccgttgtgttcatc

SEQ ID NO: 14168 - DNA, 24 bp, Homo sapiens
tgcggtgaagattatggaagtgac

SEQ ID NO: 14169 - DNA, 24 bp, Homo sapiens
cacggcgagagacacacatccttc

SEQ ID NO: 14170 - DNA, 24 bp, Homo sapiens
ctactggccacagagcgagactct

SEQ ID NO: 14171 - DNA, 24 bp, Homo sapiens
gctactggccacagagcgagactc

SEQ ID NO: 14172 - DNA, 24 bp, Homo sapiens
agctactggccacagagcgagact

SEQ ID NO: 14173 - DNA, 24 bp, Homo sapiens
cagttccacagcagcctcccccgt

SEQ ID NO: 14174 - DNA, 24 bp, Homo sapiens
tcagttccacagcagcctcccccg

SEQ ID NO: 14175 - DNA, 24 bp, Homo sapiens
ctcagttccacagcagcctccccc

SEQ ID NO: 14176 - DNA, 24 bp, Homo sapiens
aagctgctgatcccttgagcacac

SEQ ID NO: 14177 - DNA, 24 bp, Homo sapiens
tcccagctgacatgtcctgtccat

SEQ ID NO: 14178 - DNA, 24 bp, Homo sapiens
tgacaaggagaacaccgaggagag

SEQ ID NO: 14179 - DNA, 24 bp, Homo sapiens
tctatttcagaggaaactgggatg

SEQ ID NO: 14180 - DNA, 24 bp, Homo sapiens
cattgacaaggctggttctggtga

SEQ ID NO: 14181 - DNA, 24 bp, Homo sapiens
aagacattcatcgggctttccagt

SEQ ID NO: 14182 - DNA, 24 bp, Homo sapiens
actgaagtgaacaaggctggcaca

SEQ ID NO: 14183 - DNA, 24 bp, Homo sapiens
ttctaccatgctgagctgaaggag

SEQ ID NO: 14184 - DNA, 24 bp, Homo sapiens
tctgttttaaggtatggcttgcca

SEQ ID NO: 14185 - DNA, 24 bp, Homo sapiens
gtctgttttaaggtatggcttgcc

SEQ ID NO: 14186 - DNA, 24 bp, Homo sapiens
agtctgttttaaggtatggcttgc

SEQ ID NO: 14187 - DNA, 25 bp, Homo sapiens
atccacatcattgtagagtctgagg

SEQ ID NO: 14188 - DNA, 24 bp, Homo sapiens
agaggttgatgcaggtacttagcc

SEQ ID NO: 14189 - DNA, 23 bp, Homo sapiens
acagaaagtgctgcgagtggtgc

SEQ ID NO: 14190 - DNA, 24 bp, Homo sapiens
ctgtcccaagccacttaccttccc

SEQ ID NO: 14191 - DNA, 23 bp, Homo sapiens
aaggcagttgatgacttcagaca

SEQ ID NO: 14192 - DNA, 25 bp, Homo sapiens
cagttacctgtgtaatgtcaccttg

SEQ ID NO: 14193 - DNA, 24 bp, Homo sapiens
ttgacaccattctcctgcctcacc

SEQ ID NO: 14194 - DNA, 24 bp, Homo sapiens
atctcctgacctcgtgatccgcct

SEQ ID NO: 14195 - DNA, 24 bp, Homo sapiens
tcatgcctcagcctctcaagtagc

SEQ ID NO: 14196 - DNA, 24 bp, Homo sapiens
gccaagcctacaacctcattcgca

SEQ ID NO: 14197 - DNA, 24 bp, Homo sapiens
cacctcttcctcaaccttctgggc

SEQ ID NO: 14198 - DNA, 24 bp, Homo sapiens
tgaactctcagacctggaggacct

SEQ ID NO: 14199 - DNA, 24 bp, Homo sapiens
atgatgacctgaggaatgtggacg

SEQ ID NO: 14200 - DNA, 24 bp, Homo sapiens
tgcttatctaccagaccctgtgct

SEQ ID NO: 14201 - DNA, 24 bp, Homo sapiens
actttgtgctaaagccctgcgggc

SEQ ID NO: 14202 - DNA, 24 bp, Homo sapiens
ttgacttccagttttccagatcaa

SEQ ID NO: 14203 - DNA, 24 bp, Homo sapiens
tttgacttccagttttccagatca

SEQ ID NO: 14204 - DNA, 24 bp, Homo sapiens
ttttgacttccagttttccagatc

SEQ ID NO: 14205 - DNA, 24 bp, Homo sapiens
atttactggcgtggacttgtcttc

SEQ ID NO: 14206 - DNA, 24 bp, Homo sapiens
aggagtgtgggatgtaagtcagcc

SEQ ID NO: 14207 - DNA, 24 bp, Homo sapiens
actgctcccttcctttagtcctgg

SEQ ID NO: 14208 - DNA, 24 bp, Homo sapiens
actcctggcagaacaagtagcact

SEQ ID NO: 14209 - DNA, 24 bp, Homo sapiens
tgtagaagcagatggatcagaacc

SEQ ID NO: 14210 - DNA, 24 bp, Homo sapiens
agtgcctgtaggaggaacaacggt

SEQ ID NO: 14211 - DNA, 24 bp, Homo sapiens
tcagcagagagatccaaagaccca

SEQ ID NO: 14212 - DNA, 24 bp, Homo sapiens
cagccaagcattgttgaagggtga

SEQ ID NO: 14213 - DNA, 24 bp, Homo sapiens
agttatgcgttctttgctggctgc

SEQ ID NO: 14214 - DNA, 24 bp, Homo sapiens
tcagcagagagatccaaagaccca

SEQ ID NO: 14215 - DNA, 24 bp, Homo sapiens
cagccaagcattgttgaagggtga

SEQ ID NO: 14216 - DNA, 24 bp, Homo sapiens
gagttatgcgttctttgctggctg

SEQ ID NO: 14217 - DNA, 24 bp, Homo sapiens
tccttcagtctcttcacctcctcc

SEQ ID NO: 14218 - DNA, 24 bp, Homo sapiens
ggatagtcagagttcagtgtcaga

SEQ ID NO: 14219 - DNA, 24 bp, Homo sapiens
aactgtgaggcgttatgctgttgc

SEQ ID NO: 14220 - DNA, 24 bp, Homo sapiens
ttgtgatccgcctacctcgtcctc

SEQ ID NO: 14221 - DNA, 24 bp, Homo sapiens
ggccaggatggtctcaatctcttg

SEQ ID NO: 14222 - DNA, 24 bp, Homo sapiens
ggacgagcagggtgagacagactg

SEQ ID NO: 14223 - DNA, 24 bp, Homo sapiens
aggacgagcagggtgagacagact

SEQ ID NO: 14224 - DNA, 24 bp, Homo sapiens
aaggacgagcagggtgagacagac

SEQ ID NO: 14225 - DNA, 24 bp, Homo sapiens
agacaaatctgggatgatgcagtg

SEQ ID NO: 14226 - DNA, 24 bp, Homo sapiens
aagacaaatctgggatgatgcagt

SEQ ID NO: 14227 - DNA, 24 bp, Homo sapiens
aaagacaaatctgggatgatgcag

SEQ ID NO: 14228 - DNA, 24 bp, Homo sapiens
tggcggataaagccaagaccaagg

SEQ ID NO: 14229 - DNA, 24 bp, Homo sapiens
atggcggataaagccaagaccaag

SEQ ID NO: 14230 - DNA, 24 bp, Homo sapiens
gatggcggataaagccaagaccaa

SEQ ID NO: 14231 - DNA, 24 bp, Homo sapiens
tctggatcgacttcctggtgcagc

SEQ ID NO: 14232 - DNA, 24 bp, Homo sapiens
atctggatcgacttcctggtgcag

SEQ ID NO: 14233 - DNA, 24 bp, Homo sapiens
catctggatcgacttcctggtgca

SEQ ID NO: 14234 - DNA, 24 bp, Homo sapiens
gactacttcagctgtcccccaaag

SEQ ID NO: 14235 - DNA, 24 bp, Homo sapiens
tgactacttcagctgtcccccaaa

SEQ ID NO: 14236 - DNA, 24 bp, Homo sapiens
ttgactacttcagctgtcccccaa

SEQ ID NO: 14237 - DNA, 24 bp, Homo sapiens
caagaaatcaggcatgtctaagaa

SEQ ID NO: 14238 - DNA, 24 bp, Homo sapiens
ccaagaaatcaggcatgtctaaga

SEQ ID NO: 14239 - DNA, 24 bp, Homo sapiens
tccaagaaatcaggcatgtctaag

SEQ ID NO: 14240 - DNA, 24 bp, Homo sapiens
tgaaaaagaaggtctgcggtgccg

SEQ ID NO: 14241 - DNA, 24 bp, Homo sapiens
ttgaaaaagaaggtctgcggtgcc

SEQ ID NO: 14242 - DNA, 24 bp, Homo sapiens
cttgaaaaagaaggtctgcggtgc

SEQ ID NO: 14243 - DNA, 24 bp, Homo sapiens
gcatctctcaggtcagccctgaac

SEQ ID NO: 14244 - DNA, 24 bp, Homo sapiens
agcatctctcaggtcagccctgaa

SEQ ID NO: 14245 - DNA, 24 bp, Homo sapiens
cagcatctctcaggtcagccctga

SEQ ID NO: 14246 - DNA, 24 bp, Homo sapiens
catccacatcgactttggcttcat

SEQ ID NO: 14247 - DNA, 24 bp, Homo sapiens
tcatccacatcgactttggcttca

SEQ ID NO: 14248 - DNA, 24 bp, Homo sapiens
atcatccacatcgactttggcttc

SEQ ID NO: 14249 - DNA, 23 bp, Homo sapiens
tgtagatgccagcgaggtccttc

SEQ ID NO: 14250 - DNA, 25 bp, Homo sapiens
cttcactgtagatgccagcgaggtc

SEQ ID NO: 14251 - DNA, 25 bp, Homo sapiens
cctccattcactgtagatgccagcg

SEQ ID NO: 14252 - DNA, 25 bp, Homo sapiens
tggtgaagaagatcgttgaggaggc

SEQ ID NO: 14253 - DNA, 25 bp, Homo sapiens
ggatgccattgtagccagtgtgatg

SEQ ID NO: 14254 - DNA, 25 bp, Homo sapiens
gttcaagatgctgcgtgacactctg

SEQ ID NO: 14255 - DNA, 24 bp, Homo sapiens
ttaatgacttccgctccatcctcc

SEQ ID NO: 14256 - DNA, 25 bp, Homo sapiens
ggcgttacagcaacatggaagagtc

SEQ ID NO: 14257 - DNA, 25 bp, Homo sapiens
aaatccctcctcattccctccgtgt

SEQ ID NO: 14258 - DNA, 25 bp, Homo sapiens
ttcaacggtgtcacatataaggagt

SEQ ID NO: 14259 - DNA, 23 bp, Homo sapiens
tccagcatctctcaggtcagccc

SEQ ID NO: 14260 - DNA, 24 bp, Homo sapiens
ttaatgacttccgctccatcctcc

SEQ ID NO: 14261 - DNA, 25 bp, Homo sapiens
gttcaagatgctgcgtgacactctg

SEQ ID NO: 14262 - DNA, 23 bp, Homo sapiens
ggagcagttcaacacgagccagg

SEQ ID NO: 14263 - DNA, 25 bp, Homo sapiens
agaagattctacatgacgcagaccg

SEQ ID NO: 14264 - DNA, 25 bp, Homo sapiens
tgaccatgttcaagatgctgcgtga

SEQ ID NO: 14265 - DNA, 25 bp, Homo sapiens
ggatgccattgtagccagtgtgatg

SEQ ID NO: 14266 - DNA, 25 bp, Homo sapiens
tggtgaagaagatcgttgaggaggc

SEQ ID NO: 14267 - DNA, 24 bp, Homo sapiens
agaccaaggagaacgaggaggagc

SEQ ID NO: 14268 - DNA, 25 bp, Homo sapiens
gaacttcaaccacatccacaagagg

SEQ ID NO: 14269 - DNA, 25 bp, Homo sapiens
acaagtatctatctggtctggtgga

SEQ ID NO: 14270 - DNA, 25 bp, Homo sapiens
gaacttcaaccacatccacaagagg

SEQ ID NO: 14271 - DNA, 25 bp, Homo sapiens
acaagtatctatctggtctggtgga

SEQ ID NO: 14272 - DNA, 23 bp, Homo sapiens
ggactgtgctgaagaccatgctg

SEQ ID NO: 14273 - DNA, 25 bp, Homo sapiens
gaacttcaaccacatccacaagagg

SEQ ID NO: 14274 - DNA, 24 bp, Homo sapiens
agaccaaggagaacgaggaggagc

SEQ ID NO: 14275 - DNA, 23 bp, Homo sapiens
cgccatgtccacctacctcctct

SEQ ID NO: 14276 - DNA, 23 bp, Homo sapiens
ggactgtgctgaagaccatgctg

SEQ ID NO: 14277 - DNA, 25 bp, Homo sapiens
gaacttcaaccacatccacaagagg

SEQ ID NO: 14278 - DNA, 24 bp, Homo sapiens
agaccaaggagaacgaggaggagc

SEQ ID NO: 14279 - DNA, 24 bp, Homo sapiens
ccgtgagagcattgtgaaggactt

SEQ ID NO: 14280 - DNA, 23 bp, Homo sapiens
ggactgtgctgaagaccatgctg

SEQ ID NO: 14281 - DNA, 25 bp, Homo sapiens
gaacttcaaccacatccacaagagg

SEQ ID NO: 14282 - DNA, 24 bp, Homo sapiens
gaagaatgctggcgtctccgtgtg

SEQ ID NO: 14283 - DNA, 24 bp, Homo sapiens
ccctaacactgataacctgagccc

SEQ ID NO: 14284 - DNA, 24 bp, Homo sapiens
gttccatttctaccccgcacgcag

SEQ ID NO: 14285 - DNA, 24 bp, Homo sapiens
gccctgcccaggacctcagcagcc

SEQ ID NO: 14286 - DNA, 24 bp, Homo sapiens
ggccctgcccaggacctcagcagc

SEQ ID NO: 14287 - DNA, 24 bp, Homo sapiens
gggccctgcccaggacctcagcag

SEQ ID NO: 14288 - DNA, 23 bp, Homo sapiens
ccaaggagccaccctgagccaaa

SEQ ID NO: 14289 - DNA, 24 bp, Homo sapiens
attcagctctgagcggtctttgct

SEQ ID NO: 14290 - DNA, 24 bp, Homo sapiens
acctcttctgtggagtctgcgtgg

SEQ ID NO: 14291 - DNA, 24 bp, Homo sapiens
tgagcctttcagtgccacagaccc

SEQ ID NO: 14292 - DNA, 24 bp, Homo sapiens
gcatcatcttctgtgaggctgtgg

SEQ ID NO: 14293 - DNA, 24 bp, Homo sapiens
gactagatgatatgtgtgggtggg

SEQ ID NO: 14294 - DNA, 24 bp, Homo sapiens
tttcagaggcttggtgttcagggc

SEQ ID NO: 14295 - DNA, 24 bp, Homo sapiens
cttgctgcgtgttgatttggaggc

SEQ ID NO: 14296 - DNA, 24 bp, Homo sapiens
ctaacctcttctgtggagtctgcg

SEQ ID NO: 14297 - DNA, 24 bp, Homo sapiens
tcatcgtggagatctttggcagcg

SEQ ID NO: 14298 - DNA, 24 bp, Homo sapiens
ctcagaaccccagcctctttgtaa

SEQ ID NO: 14299 - DNA, 24 bp, Homo sapiens
atcaccagcatccgggatactcgc

SEQ ID NO: 14300 - DNA, 24 bp, Homo sapiens
tgcctctccagttatcctccgtgt

SEQ ID NO: 14301 - DNA, 24 bp, Homo sapiens
gagcaactagatttctggagcagc

SEQ ID NO: 14302 - DNA, 24 bp, Homo sapiens
gcctgcccaaggaccccaagatcc

SEQ ID NO: 14303 - DNA, 24 bp, Homo sapiens
cgcctgcccaaggaccccaagatc

SEQ ID NO: 14304 - DNA, 24 bp, Homo sapiens
ccgcctgcccaaggaccccaagat

SEQ ID NO: 14305 - DNA, 24 bp, Homo sapiens
ggaattctcgcccgagcctcttga

SEQ ID NO: 14306 - DNA, 24 bp, Homo sapiens
gggaattctcgcccgagcctcttg

SEQ ID NO: 14307 - DNA, 24 bp, Homo sapiens
cgggaattctcgcccgagcctctt

SEQ ID NO: 14308 - DNA, 24 bp, Homo sapiens
ggaattctcgcccgagcctcttga

SEQ ID NO: 14309 - DNA, 24 bp, Homo sapiens
gggaattctcgcccgagcctcttg

SEQ ID NO: 14310 - DNA, 24 bp, Homo sapiens
cgggaattctcgcccgagcctctt

SEQ ID NO: 14311 - DNA, 23 bp, Homo sapiens
caccatgtctcgccgcaagcaag

SEQ ID NO: 14312 - DNA, 23 bp, Homo sapiens
ctctcccgatgtgaaccgagccg

SEQ ID NO: 14313 - DNA, 25 bp, Homo sapiens
cggctctcccacaattcatcttccc

SEQ ID NO: 14314 - DNA, 24 bp, Homo sapiens
aagtgccccaggatatacccccta

SEQ ID NO: 14315 - DNA, 24 bp, Homo sapiens
gaagtgccccaggatataccccct

SEQ ID NO: 14316 - DNA, 24 bp, Homo sapiens
ggaagtgccccaggatataccccc

SEQ ID NO: 14317 - DNA, 24 bp, Homo sapiens
aaggttctcggtgctcgccatctc

SEQ ID NO: 14318 - DNA, 24 bp, Homo sapiens
aatatgacccgatgccacccgagt

SEQ ID NO: 14319 - DNA, 24 bp, Homo sapiens
cggttctcagatggtggcactcaa

SEQ ID NO: 14320 - DNA, 24 bp, Homo sapiens
cggatgcctctgctgtttacctgc

SEQ ID NO: 14321 - DNA, 24 bp, Homo sapiens
atacatgaacagcaggagcattgg

SEQ ID NO: 14322 - DNA, 24 bp, Homo sapiens
tgctgagcctttcttgtttgtgga

SEQ ID NO: 14323 - DNA, 24 bp, Homo sapiens
actggatctcctcgtcacataaca

SEQ ID NO: 14324 - DNA, 24 bp, Homo sapiens
ccatgcgtgaaactgctgagcctt

SEQ ID NO: 14325 - DNA, 24 bp, Homo sapiens
atacatgaacagcaggagcattgg

SEQ ID NO: 14326 - DNA, 24 bp, Homo sapiens
ggatggaacttgtttgacttctcc

SEQ ID NO: 14327 - DNA, 24 bp, Homo sapiens
cggatggaacttgtttgacttctc

SEQ ID NO: 14328 - DNA, 24 bp, Homo sapiens
ccggatggaacttgtttgacttct

SEQ ID NO: 14329 - DNA, 23 bp, Homo sapiens
gccatcgtggtgttggtacggca

SEQ ID NO: 14330 - DNA, 24 bp, Homo sapiens
gcattttcctggtggactgtcggt

SEQ ID NO: 14331 - DNA, 23 bp, Homo sapiens
ccatgtgcgggtgacccgagcac

SEQ ID NO: 14332 - DNA, 23 bp, Homo sapiens
tacttggtggtggcagtcaacgg

SEQ ID NO: 14333 - DNA, 25 bp, Homo sapiens
tgctgaaaggtgggaacttcttctc

SEQ ID NO: 14334 - DNA, 25 bp, Homo sapiens
tgccctggagttacctcgtctttct

SEQ ID NO: 14335 - DNA, 24 bp, Homo sapiens
agcagggccaggtcactttgtctg

SEQ ID NO: 14336 - DNA, 24 bp, Homo sapiens
gagcagggccaggtcactttgtct

SEQ ID NO: 14337 - DNA, 24 bp, Homo sapiens
ggagcagggccaggtcactttgtc

SEQ ID NO: 14338 - DNA, 24 bp, Homo sapiens
ccccaccagaggacagacgttgaa

SEQ ID NO: 14339 - DNA, 24 bp, Homo sapiens
tccccaccagaggacagacgttga

SEQ ID NO: 14340 - DNA, 24 bp, Homo sapiens
ctccccaccagaggacagacgttg

SEQ ID NO: 14341 - DNA, 24 bp, Homo sapiens
caagccatctggttttcatgagga

SEQ ID NO: 14342 - DNA, 24 bp, Homo sapiens
tcaagccatctggttttcatgagg

SEQ ID NO: 14343 - DNA, 24 bp, Homo sapiens
ctcaagccatctggttttcatgag

SEQ ID NO: 14344 - DNA, 23 bp, Homo sapiens
cagaccctcaagccatctggttt

SEQ ID NO: 14345 - DNA, 23 bp, Homo sapiens
agaccatccccaagcacagacgt

SEQ ID NO: 14346 - DNA, 23 bp, Homo sapiens
ccactgatgacaccacgacgctc

SEQ ID NO: 14347 - DNA, 24 bp, Homo sapiens
gcaggacagatgtgagtgaaccag

SEQ ID NO: 14348 - DNA, 24 bp, Homo sapiens
agcaggacagatgtgagtgaacca

SEQ ID NO: 14349 - DNA, 24 bp, Homo sapiens
aagcaggacagatgtgagtgaacc

SEQ ID NO: 14350 - DNA, 24 bp, Homo sapiens
cctgactggcttgggactgagaga

SEQ ID NO: 14351 - DNA, 23 bp, Homo sapiens
gagaggcaggaggaacgggacag

SEQ ID NO: 14352 - DNA, 23 bp, Homo sapiens
gggcaggaggagggttggatggg

SEQ ID NO: 14353 - DNA, 24 bp, Homo sapiens
cgtcctcacagtcttacacagtgt

SEQ ID NO: 14354 - DNA, 24 bp, Homo sapiens
tcgtcctcacagtcttacacagtg

SEQ ID NO: 14355 - DNA, 24 bp, Homo sapiens
atcgtcctcacagtcttacacagt

SEQ ID NO: 14356 - DNA, 24 bp, Homo sapiens
gatatgatctgggtaacgtcattc

SEQ ID NO: 14357 - DNA, 24 bp, Homo sapiens
ggatatgatctgggtaacgtcatt

SEQ ID NO: 14358 - DNA, 24 bp, Homo sapiens
aggatatgatctgggtaacgtcat

SEQ ID NO: 14359 - DNA, 24 bp, Homo sapiens
cctgacctcaggtaatccacctgc

SEQ ID NO: 14360 - DNA, 24 bp, Homo sapiens
tcctgacctcaggtaatccacctg

SEQ ID NO: 14361 - DNA, 24 bp, Homo sapiens
ttcctgacctcaggtaatccacct

SEQ ID NO: 14362 - DNA, 24 bp, Homo sapiens
ggaaagcaaaggaaccggcgaata

SEQ ID NO: 14363 - DNA, 24 bp, Homo sapiens
gggaaagcaaaggaaccggcgaat

SEQ ID NO: 14364 - DNA, 24 bp, Homo sapiens
agggaaagcaaaggaaccggcgaa

SEQ ID NO: 14365 - DNA, 24 bp, Homo sapiens
gcttcaatcccagtcccaaccagt

SEQ ID NO: 14366 - DNA, 24 bp, Homo sapiens
ccaagttactcaggagcaagggca

SEQ ID NO: 14367 - DNA, 24 bp, Homo sapiens
agcagttcaaccagtagcagcagt

SEQ ID NO: 14368 - DNA, 24 bp, Homo sapiens
caccccaccaggcaccccgactat

SEQ ID NO: 14369 - DNA, 24 bp, Homo sapiens
gcaccccaccaggcaccccgacta

SEQ ID NO: 14370 - DNA, 24 bp, Homo sapiens
tgcaccccaccaggcaccccgact

SEQ ID NO: 14371 - DNA, 24 bp, Homo sapiens
gaggcccagcggtgagagcacact

SEQ ID NO: 14372 - DNA, 24 bp, Homo sapiens
agaggcccagcggtgagagcacac

SEQ ID NO: 14373 - DNA, 24 bp, Homo sapiens
aagaggcccagcggtgagagcaca

SEQ ID NO: 14374 - DNA, 24 bp, Homo sapiens
ggacaccctgggtgagccctgccc

SEQ ID NO: 14375 - DNA, 24 bp, Homo sapiens
tggacaccctgggtgagccctgcc

SEQ ID NO: 14376 - DNA, 24 bp, Homo sapiens
ctggacaccctgggtgagccctgc

SEQ ID NO: 14377 - DNA, 24 bp, Homo sapiens
ggaggctaaggcaggagaatcact

SEQ ID NO: 14378 - DNA, 24 bp, Homo sapiens
gctacttggaggctgaggcagaag

SEQ ID NO: 14379 - DNA, 24 bp, Homo sapiens
tgggcaacagagcgagacttcatc

SEQ ID NO: 14380 - DNA, 24 bp, Homo sapiens
ggaggctaaggcaggagaatcact

SEQ ID NO: 14381 - DNA, 24 bp, Homo sapiens
tgggcaacagagcgagacttcatc

SEQ ID NO: 14382 - DNA, 24 bp, Homo sapiens
gggcaacagagcgagactccatct

SEQ ID NO: 14383 - DNA, 24 bp, Homo sapiens
tcaggtgaaccgcattcttaacga

SEQ ID NO: 14384 - DNA, 24 bp, Homo sapiens
agacaagactggctcctctgctca

SEQ ID NO: 14385 - DNA, 24 bp, Homo sapiens
acttcaagtctatggtcgtgtccg

SEQ ID NO: 14386 - DNA, 24 bp, Homo sapiens
ggctgctttgacctcctgcttgat

SEQ ID NO: 14387 - DNA, 24 bp, Homo sapiens
ctttggttcagcacccagtcccat

SEQ ID NO: 14388 - DNA, 24 bp, Homo sapiens
ctcctgccatgacaccttggaacc

SEQ ID NO: 14389 - DNA, 24 bp, Homo sapiens
gagtatctcaggtaagtgtgccaa

SEQ ID NO: 14390 - DNA, 24 bp, Homo sapiens
ggagtatctcaggtaagtgtgcca

SEQ ID NO: 14391 - DNA, 24 bp, Homo sapiens
tggagtatctcaggtaagtgtgcc

SEQ ID NO: 14392 - DNA, 24 bp, Homo sapiens
tgtgtttttaggtctgttttctat

SEQ ID NO: 14393 - DNA, 24 bp, Homo sapiens
atgtgtttttaggtctgttttcta

SEQ ID NO: 14394 - DNA, 24 bp, Homo sapiens
catgtgtttttaggtctgttttct

SEQ ID NO: 14395 - DNA, 24 bp, Homo sapiens
aagagttaggagctcgagaaccgt

SEQ ID NO: 14396 - DNA, 24 bp, Homo sapiens
gctcccacctctgcagcccaagct

SEQ ID NO: 14397 - DNA, 25 bp, Homo sapiens
tccaggagaatgaagaagcagtcaa

SEQ ID NO: 14398 - DNA, 24 bp, Homo sapiens
aggaggttgtggtggatgagagcc

SEQ ID NO: 14399 - DNA, 25 bp, Homo sapiens
gatgatgatccacccacacctgagg

SEQ ID NO: 14400 - DNA, 23 bp, Homo sapiens
caattctcctgcctcagcctcct

SEQ ID NO: 14401 - DNA, 24 bp, Homo sapiens
atcttggctaactgcaacctccgc

SEQ ID NO: 14402 - DNA, 24 bp, Homo sapiens
gtagtatctgatgactttctggct

SEQ ID NO: 14403 - DNA, 24 bp, Homo sapiens
cgtagtatctgatgactttctggc

SEQ ID NO: 14404 - DNA, 24 bp, Homo sapiens
acgtagtatctgatgactttctgg

SEQ ID NO: 14405 - DNA, 24 bp, Homo sapiens
tcaaaaagaagggaacacggatgc

SEQ ID NO: 14406 - DNA, 24 bp, Homo sapiens
ttcaaaaagaagggaacacggatg

SEQ ID NO: 14407 - DNA, 24 bp, Homo sapiens
tttcaaaaagaagggaacacggat

SEQ ID NO: 14408 - DNA, 25 bp, Homo sapiens
tcaagtattccagcaaagcagtcgt

SEQ ID NO: 14409 - DNA, 25 bp, Homo sapiens
gcagaatcagatgaacttaccgtag

SEQ ID NO: 14410 - DNA, 25 bp, Homo sapiens
agagtcgtggctgtatcagatggag

SEQ ID NO: 14411 - DNA, 25 bp, Homo sapiens
tcaagtattccagcaaagcagtcgt

SEQ ID NO: 14412 - DNA, 25 bp, Homo sapiens
acatgatgttggaaatcttagtgga

SEQ ID NO: 14413 - DNA, 25 bp, Homo sapiens
agagtcgtggctgtatcagatggag

SEQ ID NO: 14414 - DNA, 25 bp, Homo sapiens
gaagaacctccaggaacacagaagc

SEQ ID NO: 14415 - DNA, 25 bp, Homo sapiens
gtatgctcagttactcacaggtcgt

SEQ ID NO: 14416 - DNA, 25 bp, Homo sapiens
gaagaacctccaggaacacagaagc

SEQ ID NO: 14417 - DNA, 25 bp, Homo sapiens
agagtcgtggctgtatcagatggag

SEQ ID NO: 14418 - DNA, 25 bp, Homo sapiens
tcaagtattccagcaaagcagtcgt

SEQ ID NO: 14419 - DNA, 25 bp, Homo sapiens
aagaaagttggaagtgaatggatgt

SEQ ID NO: 14420 - DNA, 25 bp, Homo sapiens
agcaaatgtgggtttaaatctcaaa

SEQ ID NO: 14421 - DNA, 24 bp, Homo sapiens
aagaaaaatgaggaggtacctgga

SEQ ID NO: 14422 - DNA, 25 bp, Homo sapiens
tgaatatggattaccctctcagcct

SEQ ID NO: 14423 - DNA, 25 bp, Homo sapiens
tggaccataagaatgaaatcaaaca

SEQ ID NO: 14424 - DNA, 25 bp, Homo sapiens
aatgaaatccctgtttcctctaaca

SEQ ID NO: 14425 - DNA, 24 bp, Homo sapiens
gcccaaagaagccccttcgcagct

SEQ ID NO: 14426 - DNA, 24 bp, Homo sapiens
ggcccaaagaagccccttcgcagc

SEQ ID NO: 14427 - DNA, 24 bp, Homo sapiens
gggcccaaagaagccccttcgcag

SEQ ID NO: 14428 - DNA, 24 bp, Homo sapiens
ggttcaagtgattctcctgcctca

SEQ ID NO: 14429 - DNA, 23 bp, Homo sapiens
tcttggctcactgcaacttccgc

SEQ ID NO: 14430 - DNA, 23 bp, Homo sapiens
cgagtagctgggattacaggcat

SEQ ID NO: 14431 - DNA, 23 bp, Homo sapiens
cacccgcctcagcctcccaaagt

SEQ ID NO: 14432 - DNA, 25 bp, Homo sapiens
ttacagatgtgagtcactgcacccg

SEQ ID NO: 14433 - DNA, 24 bp, Homo sapiens
ttggtctccaactcctgacctcaa

SEQ ID NO: 14434 - DNA, 25 bp, Homo sapiens
tctccaactcctgacctcaagtgat

SEQ ID NO: 14435 - DNA, 25 bp, Homo sapiens
caaagtgctgggattacagatgtga

SEQ ID NO: 14436 - DNA, 23 bp, Homo sapiens
agattctcccgcctcagcctccg

SEQ ID NO: 14437 - DNA, 23 bp, Homo sapiens
aggctggagtgcagtggcatgat

SEQ ID NO: 14438 - DNA, 24 bp, Homo sapiens
tcactgcaacctctgcttctggga

SEQ ID NO: 14439 - DNA, 24 bp, Homo sapiens
gagcacaacaggtcagggagggca

SEQ ID NO: 14440 - DNA, 24 bp, Homo sapiens
tgagcacaacaggtcagggagggc

SEQ ID NO: 14441 - DNA, 24 bp, Homo sapiens
ctgagcacaacaggtcagggaggg

SEQ ID NO: 14442 - DNA, 24 bp, Homo sapiens
tctctttgcagaacccccaaaata

SEQ ID NO: 14443 - DNA, 24 bp, Homo sapiens
ttctctttgcagaacccccaaaat

SEQ ID NO: 14444 - DNA, 24 bp, Homo sapiens
tttctctttgcagaacccccaaaa

SEQ ID NO: 14445 - DNA, 24 bp, Homo sapiens
ccagtacaaagatcaaggctgaag

SEQ ID NO: 14446 - DNA, 24 bp, Homo sapiens
cccagtacaaagatcaaggctgaa

SEQ ID NO: 14447 - DNA, 24 bp, Homo sapiens
ccccagtacaaagatcaaggctga

SEQ ID NO: 14448 - DNA, 24 bp, Homo sapiens
gagcacaacagaagcacaatggtg

SEQ ID NO: 14449 - DNA, 24 bp, Homo sapiens
tgagcacaacagaagcacaatggt

SEQ ID NO: 14450 - DNA, 24 bp, Homo sapiens
ctgagcacaacagaagcacaatgg

SEQ ID NO: 14451 - DNA, 24 bp, Homo sapiens
caccttcaagcaacgccgcatcaa

SEQ ID NO: 14452 - DNA, 24 bp, Homo sapiens
caacgacttcagccagacgaccat

SEQ ID NO: 14453 - DNA, 24 bp, Homo sapiens
tatgtctgtggactcaagcctgcc

SEQ ID NO: 14454 - DNA, 24 bp, Homo sapiens
agaaagtccagaaataagaatgtc

SEQ ID NO: 14455 - DNA, 24 bp, Homo sapiens
aagaaagtccagaaataagaatgt

SEQ ID NO: 14456 - DNA, 24 bp, Homo sapiens
gaagaaagtccagaaataagaatg

SEQ ID NO: 14457 - DNA, 24 bp, Homo sapiens
ctgcccaagagaaataagaatgtc

SEQ ID NO: 14458 - DNA, 24 bp, Homo sapiens
tctgcccaagagaaataagaatgt

SEQ ID NO: 14459 - DNA, 24 bp, Homo sapiens
gtctgcccaagagaaataagaatg

SEQ ID NO: 14460 - DNA, 24 bp, Homo sapiens
agctagctggggcctgctaccgac

SEQ ID NO: 14461 - DNA, 22 bp, Homo sapiens
gctagctggggcctgctaccga

SEQ ID NO: 14462 - DNA, 22 bp, Homo sapiens
agctagctggggcctgctaccg

SEQ ID NO: 14463 - DNA, 24 bp, Homo sapiens
atgggcaagctctacggcaacgac

SEQ ID NO: 14464 - DNA, 24 bp, Homo sapiens
cagacgaccatttcccgcttcgag

SEQ ID NO: 14465 - DNA, 24 bp, Homo sapiens
gcaaactcaagcccctcctggaga

SEQ ID NO: 14466 - DNA, 24 bp, Homo sapiens
ccactcggctatcggcttgtcagg

SEQ ID NO: 14467 - DNA, 24 bp, Homo sapiens
cttgatggcagcgggaatctggtg

SEQ ID NO: 14468 - DNA, 24 bp, Homo sapiens
gtgacctcgccgctcttcttgaat

SEQ ID NO: 14469 - DNA, 25 bp, Homo sapiens
aatggaatggcagtggaaaatgggc

SEQ ID NO: 14470 - DNA, 25 bp, Homo sapiens
gaacctgatggacaaagtgaaccaa

SEQ ID NO: 14471 - DNA, 25 bp, Homo sapiens
tggacatacagcttggtatcagttc

SEQ ID NO: 14472 - DNA, 24 bp, Homo sapiens
tacagcaccagaaccctcagcagt

SEQ ID NO: 14473 - DNA, 25 bp, Homo sapiens
tcaactggtggaggaagaaggtcgt

SEQ ID NO: 14474 - DNA, 24 bp, Homo sapiens
gcaaaggaaactggtgacacttgt

SEQ ID NO: 14475 - DNA, 23 bp, Homo sapiens
atcaaccagtcctcccgcctcag

SEQ ID NO: 14476 - DNA, 25 bp, Homo sapiens
ggagtgcaatggtgccatcatagct

SEQ ID NO: 14477 - DNA, 24 bp, Homo sapiens
tgctgctagcggaggcgccatatt

SEQ ID NO: 14478 - DNA, 24 bp, Homo sapiens
gtgctgctagcggaggcgccatat

SEQ ID NO: 14479 - DNA, 24 bp, Homo sapiens
ggtgctgctagcggaggcgccata

SEQ ID NO: 14480 - DNA, 24 bp, Homo sapiens
cctgaaagaaggtcagtgttgtgg

SEQ ID NO: 14481 - DNA, 24 bp, Homo sapiens
acctgaaagaaggtcagtgttgtg

SEQ ID NO: 14482 - DNA, 24 bp, Homo sapiens
aacctgaaagaaggtcagtgttgt

SEQ ID NO: 14483 - DNA, 25 bp, Homo sapiens
ggagatcgagccattgtaccacctt

SEQ ID NO: 14484 - DNA, 24 bp, Homo sapiens
taaccagcccttgatgcctttgcc

SEQ ID NO: 14485 - DNA, 25 bp, Homo sapiens
cctctccagttcctgtgtcaataca

SEQ ID NO: 14486 - DNA, 25 bp, Homo sapiens
acatctaactcctgcggtgccttct

SEQ ID NO: 14487 - DNA, 23 bp, Homo sapiens
ttgaccactggacctgattcagc

SEQ ID NO: 14488 - DNA, 25 bp, Homo sapiens
cctctccagttcctgtgtcaataca

SEQ ID NO: 14489 - DNA, 24 bp, Homo sapiens
gggaggccaaggcaggcagatcac

SEQ ID NO: 14490 - DNA, 24 bp, Homo sapiens
tgggaggccaaggcaggcagatca

SEQ ID NO: 14491 - DNA, 24 bp, Homo sapiens
ttgggaggccaaggcaggcagatc

SEQ ID NO: 14492 - DNA, 24 bp, Homo sapiens
gctcactagatgggctcctcacag

SEQ ID NO: 14493 - DNA, 24 bp, Homo sapiens
ccctgtggtgctttggctcaatgg

SEQ ID NO: 14494 - DNA, 24 bp, Homo sapiens
ctccaagcacctccactactggtt

SEQ ID NO: 14495 - DNA, 24 bp, Homo sapiens
ggcttctcctactccgatgacaag

SEQ ID NO: 14496 - DNA, 24 bp, Homo sapiens
gcaactaatgacactgaggtcgcc

SEQ ID NO: 14497 - DNA, 24 bp, Homo sapiens
gtacaagaacaacaaacttttcct

SEQ ID NO: 14498 - DNA, 24 bp, Homo sapiens
gtacaagaacaacaaacttttcct

SEQ ID NO: 14499 - DNA, 24 bp, Homo sapiens
ggagagctatgctggcatctacat

SEQ ID NO: 14500 - DNA, 24 bp, Homo sapiens
tggccgtgctggtcatgcaggatc

SEQ ID NO: 14501 - DNA, 24 bp, Homo sapiens
gccacccccttatgcctctttgac

SEQ ID NO: 14502 - DNA, 24 bp, Homo sapiens
tgccacccccttatgcctctttga

SEQ ID NO: 14503 - DNA, 24 bp, Homo sapiens
atgccacccccttatgcctctttg

SEQ ID NO: 14504 - DNA, 25 bp, Homo sapiens
acatggcagttcgttacggagactt

SEQ ID NO: 14505 - DNA, 23 bp, Homo sapiens
gcctcggactgagacagaatctg

SEQ ID NO: 14506 - DNA, 25 bp, Homo sapiens
ggaatattaggactgaggcaacacc

SEQ ID NO: 14507 - DNA, 25 bp, Homo sapiens
acctcaactgacagtgaagtggaga

SEQ ID NO: 14508 - DNA, 23 bp, Homo sapiens
agccacggaaccgcagtaggatt

SEQ ID NO: 14509 - DNA, 25 bp, Homo sapiens
cagcagaagttgtggaccttaccgt

SEQ ID NO: 14510 - DNA, 25 bp, Homo sapiens
cagaatgcagcagaagttgtggacc

SEQ ID NO: 14511 - DNA, 24 bp, Homo sapiens
agttctcatgcaagtcggccacag

SEQ ID NO: 14512 - DNA, 23 bp, Homo sapiens
cggaaccgcagtaggatttctac

SEQ ID NO: 14513 - DNA, 25 bp, Homo sapiens
cagaatgcagcagaagttgtggacc

SEQ ID NO: 14514 - DNA, 23 bp, Homo sapiens
agccacggaaccgcagtaggatt

SEQ ID NO: 14515 - DNA, 25 bp, Homo sapiens
ggttccagttctcatgcaagtcggc

SEQ ID NO: 14516 - DNA, 24 bp, Homo sapiens
agtccaagaccgtgagtacatggg

SEQ ID NO: 14517 - DNA, 24 bp, Homo sapiens
gagtccaagaccgtgagtacatgg

SEQ ID NO: 14518 - DNA, 24 bp, Homo sapiens
tgagtccaagaccgtgagtacatg

SEQ ID NO: 14519 - DNA, 25 bp, Homo sapiens
gcgacacagatatgtaccacagagc

SEQ ID NO: 14520 - DNA, 23 bp, Homo sapiens
cagccgactgtcagaggtgcagg

SEQ ID NO: 14521 - DNA, 23 bp, Homo sapiens
ccagccacaccaccgaggtccaa

SEQ ID NO: 14522 - DNA, 24 bp, Homo sapiens
ttcacttccagccctgcctctttc

SEQ ID NO: 14523 - DNA, 24 bp, Homo sapiens
cttcacttccagccctgcctcttt

SEQ ID NO: 14524 - DNA, 24 bp, Homo sapiens
gcttcacttccagccctgcctctt

SEQ ID NO: 14525 - DNA, 24 bp, Homo sapiens
tgtgatgtaagttttccagccaat

SEQ ID NO: 14526 - DNA, 24 bp, Homo sapiens
atgtgatgtaagttttccagccaa

SEQ ID NO: 14527 - DNA, 24 bp, Homo sapiens
catgtgatgtaagttttccagcca

SEQ ID NO: 14528 - DNA, 24 bp, Homo sapiens
ggtcgacgatggtggaaatatgca

SEQ ID NO: 14529 - DNA, 24 bp, Homo sapiens
tggtcgacgatggtggaaatatgc

SEQ ID NO: 14530 - DNA, 24 bp, Homo sapiens
atggtcgacgatggtggaaatatg

SEQ ID NO: 14531 - DNA, 24 bp, Homo sapiens
aaaatgccctgagtgaattggatg

SEQ ID NO: 14532 - DNA, 24 bp, Homo sapiens
gaaaatgccctgagtgaattggat

SEQ ID NO: 14533 - DNA, 24 bp, Homo sapiens
agaaaatgccctgagtgaattgga

SEQ ID NO: 14534 - DNA, 24 bp, Homo sapiens
tacaaacagagtgggtcaccagaa

SEQ ID NO: 14535 - DNA, 24 bp, Homo sapiens
atacaaacagagtgggtcaccaga

SEQ ID NO: 14536 - DNA, 24 bp, Homo sapiens
catacaaacagagtgggtcaccag

SEQ ID NO: 14537 - DNA, 24 bp, Homo sapiens
atctgttaaaggatggatgtggac

SEQ ID NO: 14538 - DNA, 24 bp, Homo sapiens
gatctgttaaaggatggatgtgga

SEQ ID NO: 14539 - DNA, 24 bp, Homo sapiens
tgatctgttaaaggatggatgtgg

SEQ ID NO: 14540 - DNA, 24 bp, Homo sapiens
acacacagtaggtggtgcagcagg

SEQ ID NO: 14541 - DNA, 24 bp, Homo sapiens
gacacacagtaggtggtgcagcag

SEQ ID NO: 14542 - DNA, 24 bp, Homo sapiens
ggacacacagtaggtggtgcagca

SEQ ID NO: 14543 - DNA, 24 bp, Homo sapiens
ggcattcagagggcagcagaatca

SEQ ID NO: 14544 - DNA, 24 bp, Homo sapiens
aggcattcagagggcagcagaatc

SEQ ID NO: 14545 - DNA, 24 bp, Homo sapiens
aaggcattcagagggcagcagaat

SEQ ID NO: 14546 - DNA, 24 bp, Homo sapiens
ccacagcagaggtaaacaatttaa

SEQ ID NO: 14547 - DNA, 24 bp, Homo sapiens
gccacagcagaggtaaacaattta

SEQ ID NO: 14548 - DNA, 24 bp, Homo sapiens
cgccacagcagaggtaaacaattt

SEQ ID NO: 14549 - DNA, 24 bp, Homo sapiens
ggcagcagaatcaactgaggaagt

SEQ ID NO: 14550 - DNA, 25 bp, Homo sapiens
caactggtggaatcgtagatatggc

SEQ ID NO: 14551 - DNA, 24 bp, Homo sapiens
gcgaggagttgttggtggagtgac

SEQ ID NO: 14552 - DNA, 23 bp, Homo sapiens
atggtgctggagtcggtggtcgc

SEQ ID NO: 14553 - DNA, 24 bp, Homo sapiens
ctcctccctctccttgtgcctcag

SEQ ID NO: 14554 - DNA, 23 bp, Homo sapiens
gaacctgaacaagtcccagctga

SEQ ID NO: 14555 - DNA, 25 bp, Homo sapiens
gggcggaaatgtggctttagataat

SEQ ID NO: 14556 - DNA, 25 bp, Homo sapiens
ggactatgtggagaacctgaacaag

SEQ ID NO: 14557 - DNA, 23 bp, Homo sapiens
atggtgctggagtcggtggtcgc

SEQ ID NO: 14558 - DNA, 25 bp, Homo sapiens
aaatgccctgagtgaattggatgtt

SEQ ID NO: 14559 - DNA, 25 bp, Homo sapiens
gggcggaaatgtggctttagataat

SEQ ID NO: 14560 - DNA, 25 bp, Homo sapiens
ggactatgtggagaacctgaacaag

SEQ ID NO: 14561 - DNA, 25 bp, Homo sapiens
gatgatgtcactgatccaaagcggc

SEQ ID NO: 14562 - DNA, 24 bp, Homo sapiens
catttggtgtcacactgggagagc

SEQ ID NO: 14563 - DNA, 25 bp, Homo sapiens
gcagcatgtcttaccagagatcaag

SEQ ID NO: 14564 - DNA, 25 bp, Homo sapiens
aagcacaggcagttactcaagagtt

SEQ ID NO: 14565 - DNA, 24 bp, Homo sapiens
acaagttgaggtgattcggtctgg

SEQ ID NO: 14566 - DNA, 23 bp, Homo sapiens
aagtctgctgacacaggcgagaa

SEQ ID NO: 14567 - DNA, 25 bp, Homo sapiens
aagcacaggcagttactcaagagtt

SEQ ID NO: 14568 - DNA, 24 bp, Homo sapiens
acacagatgtggtcatggagtaac

SEQ ID NO: 14569 - DNA, 25 bp, Homo sapiens
aacacagtctaaagtctcagaagaa

SEQ ID NO: 14570 - DNA, 23 bp, Homo sapiens
aagtctgctgacacaggcgagaa

SEQ ID NO: 14571 - DNA, 23 bp, Homo sapiens
aggctggtttagtgggttgtggg

SEQ ID NO: 14572 - DNA, 23 bp, Homo sapiens
agagtctaagaaaaaggacgaag

SEQ ID NO: 14573 - DNA, 25 bp, Homo sapiens
ctgaccagaagatgaaagatgtgct

SEQ ID NO: 14574 - DNA, 25 bp, Homo sapiens
tgccacagaaatcatcagcccagtc

SEQ ID NO: 14575 - DNA, 25 bp, Homo sapiens
tgctagacactgtggaatcagagtc

SEQ ID NO: 14576 - DNA, 25 bp, Homo sapiens
acctttgccacagaaatcatcagcc

SEQ ID NO: 14577 - DNA, 25 bp, Homo sapiens
accagaagatgaaagatgtgctata

SEQ ID NO: 14578 - DNA, 23 bp, Homo sapiens
acttcctttgatgcatgtgagaa

SEQ ID NO: 14579 - DNA, 25 bp, Homo sapiens
tgctagacactgtggaatcagagtc

SEQ ID NO: 14580 - DNA, 25 bp, Homo sapiens
tgctgaagatggagaaccacagact

SEQ ID NO: 14581 - DNA, 25 bp, Homo sapiens
aggaacagaggccacaatgagaaca

SEQ ID NO: 14582 - DNA, 25 bp, Homo sapiens
tgctgaagatggagaaccacagact

SEQ ID NO: 14583 - DNA, 25 bp, Homo sapiens
aggaacagaggccacaatgagaaca

SEQ ID NO: 14584 - DNA, 25 bp, Homo sapiens
ccttcacttgattagctcttctgac

SEQ ID NO: 14585 - DNA, 25 bp, Homo sapiens
tgctgaagatggagaaccacagact

SEQ ID NO: 14586 - DNA, 25 bp, Homo sapiens
actattgctagacactgtggaatca

SEQ ID NO: 14587 - DNA, 25 bp, Homo sapiens
tgccacagaaatcatcagcccagtc

SEQ ID NO: 14588 - DNA, 23 bp, Homo sapiens
gttactcagttaggaacagaggc

SEQ ID NO: 14589 - DNA, 24 bp, Homo sapiens
gctcatcaatcttctactcaagtt

SEQ ID NO: 14590 - DNA, 25 bp, Homo sapiens
tgctgaagatggagaaccacagact

SEQ ID NO: 14591 - DNA, 25 bp, Homo sapiens
tgtgaagtgtcctgccaacaatatg

SEQ ID NO: 14592 - DNA, 25 bp, Homo sapiens
ttgcttcttcagagtgccttccatt

SEQ ID NO: 14593 - DNA, 24 bp, Homo sapiens
ataaccgacaggataatggcactt

SEQ ID NO: 14594 - DNA, 25 bp, Homo sapiens
aacactgccgaacattcaactgtca

SEQ ID NO: 14595 - DNA, 24 bp, Homo sapiens
gcacctgccttgataatgaaccat

SEQ ID NO: 14596 - DNA, 25 bp, Homo sapiens
actgggtatcatttctggatgggcg

SEQ ID NO: 14597 - DNA, 25 bp, Homo sapiens
aacactgccgaacattcaactgtca

SEQ ID NO: 14598 - DNA, 25 bp, Homo sapiens
gccttgataatgaaccatacaccat

SEQ ID NO: 14599 - DNA, 23 bp, Homo sapiens
tttctgattaccatgagggatct

SEQ ID NO: 14600 - DNA, 25 bp, Homo sapiens
actgggtatcatttctggatgggcg

SEQ ID NO: 14601 - DNA, 24 bp, Homo sapiens
ttcaccgatgatgttgccttggtt

SEQ ID NO: 14602 - DNA, 25 bp, Homo sapiens
gcaggcagaagaaatggaacaggct

SEQ ID NO: 14603 - DNA, 23 bp, Homo sapiens
gcctgggcagatcctactggtac

SEQ ID NO: 14604 - DNA, 23 bp, Homo sapiens
acttacatggacatatgcagcaa

SEQ ID NO: 14605 - DNA, 23 bp, Homo sapiens
tcttgctgccaagacaggctcga

SEQ ID NO: 14606 - DNA, 25 bp, Homo sapiens
gaggtctgtctgaaggagttgaagc

SEQ ID NO: 14607 - DNA, 25 bp, Homo sapiens
ggttagtgattggagtgagaagcct

SEQ ID NO: 14608 - DNA, 25 bp, Homo sapiens
tggcagcaattacaatggacaagga

SEQ ID NO: 14609 - DNA, 25 bp, Homo sapiens
ggttagtgattggagtgagaagcct

SEQ ID NO: 14610 - DNA, 25 bp, Homo sapiens
tggcagcaattacaatggacaagga

SEQ ID NO: 14611 - DNA, 24 bp, Homo sapiens
gcgaggagttgttggtggagtgac

SEQ ID NO: 14612 - DNA, 24 bp, Homo sapiens
ggttagtgattggagtgagaagcc

SEQ ID NO: 14613 - DNA, 25 bp, Homo sapiens
gaggtctgtctgaaggagttgaagc

SEQ ID NO: 14614 - DNA, 24 bp, Homo sapiens
gcttatatggagtgttgttaggca

SEQ ID NO: 14615 - DNA, 24 bp, Homo sapiens
cagtgccaatcaaggctgtgttcg

SEQ ID NO: 14616 - DNA, 24 bp, Homo sapiens
tttcttctcagcttaccacagtgc

SEQ ID NO: 14617 - DNA, 24 bp, Homo sapiens
ttttcttctcagcttaccacagtg

SEQ ID NO: 14618 - DNA, 24 bp, Homo sapiens
tttttcttctcagcttaccacagt

SEQ ID NO: 14619 - DNA, 25 bp, Homo sapiens
ggcaattctgatgaagatgaggagc

SEQ ID NO: 14620 - DNA, 25 bp, Homo sapiens
acatggacaccttattcctactggt

SEQ ID NO: 14621 - DNA, 25 bp, Homo sapiens
tgatgatggaataccagaccaagag

SEQ ID NO: 14622 - DNA, 25 bp, Homo sapiens
cgtgaacactagggatgaagatgag

SEQ ID NO: 14623 - DNA, 25 bp, Homo sapiens
cgagcagcctacagtggacacttag

SEQ ID NO: 14624 - DNA, 23 bp, Homo sapiens
agtgactgtggatggctggacgc

SEQ ID NO: 14625 - DNA, 24 bp, Homo sapiens
tctggttaaaggccagtctgccat

SEQ ID NO: 14626 - DNA, 24 bp, Homo sapiens
ttctggttaaaggccagtctgcca

SEQ ID NO: 14627 - DNA, 24 bp, Homo sapiens
attctggttaaaggccagtctgcc

SEQ ID NO: 14628 - DNA, 24 bp, Homo sapiens
cattccaatggaagaacaagacaa

SEQ ID NO: 14629 - DNA, 24 bp, Homo sapiens
tcattccaatggaagaacaagaca

SEQ ID NO: 14630 - DNA, 24 bp, Homo sapiens
ttcattccaatggaagaacaagac

SEQ ID NO: 14631 - DNA, 24 bp, Homo sapiens
tattatcagaggtaaatcggcatc

SEQ ID NO: 14632 - DNA, 24 bp, Homo sapiens
atattatcagaggtaaatcggcat

SEQ ID NO: 14633 - DNA, 24 bp, Homo sapiens
catattatcagaggtaaatcggca

SEQ ID NO: 14634 - DNA, 24 bp, Homo sapiens
agaccctgttccaaccctgtaact

SEQ ID NO: 14635 - DNA, 24 bp, Homo sapiens
gctccatcgcccttcaccatcagt

SEQ ID NO: 14636 - DNA, 24 bp, Homo sapiens
gccacctgcaaccccaacctcaat

SEQ ID NO: 14637 - DNA, 24 bp, Homo sapiens
caaagctccatcgcccttcaccat

SEQ ID NO: 14638 - DNA, 24 bp, Homo sapiens
accccaagtttcagaccctgttcc

SEQ ID NO: 14639 - DNA, 24 bp, Homo sapiens
gtaacttgatgggagctatgcagc

SEQ ID NO: 14640 - DNA, 24 bp, Homo sapiens
caaatccaccttcttgccacctgc

SEQ ID NO: 14641 - DNA, 24 bp, Homo sapiens
gctccatcgcccttcaccatcagt

SEQ ID NO: 14642 - DNA, 24 bp, Homo sapiens
agaccctgttccaaccctgtaact

SEQ ID NO: 14643 - DNA, 24 bp, Homo sapiens
agctccatcgcccttcaccatcag

SEQ ID NO: 14644 - DNA, 24 bp, Homo sapiens
acttcagcacacatgtcagcattg

SEQ ID NO: 14645 - DNA, 24 bp, Homo sapiens
acttgatgggagctatgcagctga

SEQ ID NO: 14646 - DNA, 24 bp, Homo sapiens
tcgtcttcaccaaggctgaggaca

SEQ ID NO: 14647 - DNA, 24 bp, Homo sapiens
tgttccctgaaggcaaagaatccc

SEQ ID NO: 14648 - DNA, 24 bp, Homo sapiens
tgcgaatgaatttccctgtttgcc

SEQ ID NO: 14649 - DNA, 24 bp, Homo sapiens
gaagaactgcggcacatggctgat

SEQ ID NO: 14650 - DNA, 24 bp, Homo sapiens
tgaagccagttgccacccgtttcc

SEQ ID NO: 14651 - DNA, 24 bp, Homo sapiens
ttggagacagaagcgttcatcagt

SEQ ID NO: 14652 - DNA, 24 bp, Homo sapiens
ctccacaacagaggtgcccccacc

SEQ ID NO: 14653 - DNA, 24 bp, Homo sapiens
cctccacaacagaggtgcccccac

SEQ ID NO: 14654 - DNA, 24 bp, Homo sapiens
ccctccacaacagaggtgccccca

SEQ ID NO: 14655 - DNA, 25 bp, Homo sapiens
gctcctctgaaccaaccatcctgtc

SEQ ID NO: 14656 - DNA, 23 bp, Homo sapiens
tggccgctgggtgggctccaggg

SEQ ID NO: 14657 - DNA, 24 bp, Homo sapiens
agcaggttcaggtccaggtgcagg

SEQ ID NO: 14658 - DNA, 24 bp, Homo sapiens
cagcaggttcaggtccaggtgcag

SEQ ID NO: 14659 - DNA, 24 bp, Homo sapiens
gcagcaggttcaggtccaggtgca

SEQ ID NO: 14660 - DNA, 24 bp, Homo sapiens
gttccagcagacagccaccactac

SEQ ID NO: 14661 - DNA, 24 bp, Homo sapiens
gaacttgcctgtccagtcaccacc

SEQ ID NO: 14662 - DNA, 23 bp, Homo sapiens
ttcagcagccgcagcaggttcag

SEQ ID NO: 14663 - DNA, 25 bp, Homo sapiens
cacaactcaccgttcaccagcctac

SEQ ID NO: 14664 - DNA, 23 bp, Homo sapiens
cagcagtctccgcaacaggtctc

SEQ ID NO: 14665 - DNA, 24 bp, Homo sapiens
tacagcagtctccgcaacaggtct

SEQ ID NO: 14666 - DNA, 23 bp, Homo sapiens
ttcagcagccgcagcaggttcag

SEQ ID NO: 14667 - DNA, 24 bp, Homo sapiens
gaacttgcctgtccagtcaccacc

SEQ ID NO: 14668 - DNA, 24 bp, Homo sapiens
cacctctgaagtcttctcattcac

SEQ ID NO: 14669 - DNA, 24 bp, Homo sapiens
gcacctctgaagtcttctcattca

SEQ ID NO: 14670 - DNA, 24 bp, Homo sapiens
agcacctctgaagtcttctcattc

SEQ ID NO: 14671 - DNA, 25 bp, Homo sapiens
ctggttgactgggcatctaaaggga

SEQ ID NO: 14672 - DNA, 25 bp, Homo sapiens
gccaaacaaggaagagtatatgccc

SEQ ID NO: 14673 - DNA, 24 bp, Homo sapiens
cttgagatcgggagttcgtgacca

SEQ ID NO: 14674 - DNA, 25 bp, Homo sapiens
acagaatgaagccacttggaggatg

SEQ ID NO: 14675 - DNA, 25 bp, Homo sapiens
aggatggtaatggtagtgatgtgct

SEQ ID NO: 14676 - DNA, 25 bp, Homo sapiens
tgactgaagccttattgtctggaga

SEQ ID NO: 14677 - DNA, 25 bp, Homo sapiens
gagtcctaacatctagcagctctac

SEQ ID NO: 14678 - DNA, 23 bp, Homo sapiens
taggatcacaacttctgaggtcc

SEQ ID NO: 14679 - DNA, 23 bp, Homo sapiens
gacaggccccctaaaactaattc

SEQ ID NO: 14680 - DNA, 25 bp, Homo sapiens
gctaaatcaccagtttccaagggca

SEQ ID NO: 14681 - DNA, 25 bp, Homo sapiens
acaccagatgttcttgacagctcat

SEQ ID NO: 14682 - DNA, 25 bp, Homo sapiens
accagcggacaagcaagacaactac

SEQ ID NO: 14683 - DNA, 25 bp, Homo sapiens
gctaaatcaccagtttccaagggca

SEQ ID NO: 14684 - DNA, 25 bp, Homo sapiens
acaccagatgttcttgacagctcat

SEQ ID NO: 14685 - DNA, 25 bp, Homo sapiens
agcggacaagcaagacaactactga

SEQ ID NO: 14686 - DNA, 24 bp, Homo sapiens
tgactttttaggtgccacgtgtgc

SEQ ID NO: 14687 - DNA, 24 bp, Homo sapiens
ttgactttttaggtgccacgtgtg

SEQ ID NO: 14688 - DNA, 24 bp, Homo sapiens
gttgactttttaggtgccacgtgt

SEQ ID NO: 14689 - DNA, 24 bp, Homo sapiens
tagtccagttgggttaccatccat

SEQ ID NO: 14690 - DNA, 24 bp, Homo sapiens
ctagtccagttgggttaccatcca

SEQ ID NO: 14691 - DNA, 24 bp, Homo sapiens
actagtccagttgggttaccatcc

SEQ ID NO: 14692 - DNA, 25 bp, Homo sapiens
gcaacagtgagagtagcagtggtgg

SEQ ID NO: 14693 - DNA, 25 bp, Homo sapiens
agtgattcagataacttggacagca

SEQ ID NO: 14694 - DNA, 25 bp, Homo sapiens
gcaaccaccaccactacgattggaa

SEQ ID NO: 14695 - DNA, 25 bp, Homo sapiens
aaggagtcagtgccagtcaagatcg

SEQ ID NO: 14696 - DNA, 24 bp, Homo sapiens
ccgttggacacagtggaatctggt

SEQ ID NO: 14697 - DNA, 25 bp, Homo sapiens
cagaaggcttatcaggttggtcgca

SEQ ID NO: 14698 - DNA, 23 bp, Homo sapiens
ccaatcggaacacggctctcacc

SEQ ID NO: 14699 - DNA, 24 bp, Homo sapiens
actgagtctagctgcgtctggagg

SEQ ID NO: 14700 - DNA, 25 bp, Homo sapiens
cctgatgttggctgcaatgaatgga

SEQ ID NO: 14701 - DNA, 25 bp, Homo sapiens
catcttcctcttctgctcctctggc

SEQ ID NO: 14702 - DNA, 25 bp, Homo sapiens
gctcctgttgggactcctagtttca

SEQ ID NO: 14703 - DNA, 23 bp, Homo sapiens
cggcataccaggaacaagggttt

SEQ ID NO: 14704 - DNA, 25 bp, Homo sapiens
agtgagacctgtgaatcctggcaac

SEQ ID NO: 14705 - DNA, 23 bp, Homo sapiens
gcaacagattcggcatcctcgct

SEQ ID NO: 14706 - DNA, 25 bp, Homo sapiens
aaccttctcaccttctcctaacaca

SEQ ID NO: 14707 - DNA, 23 bp, Homo sapiens
cctccaggtagcagatcaggacc

SEQ ID NO: 14708 - DNA, 25 bp, Homo sapiens
gcatagtagaggagactgaaggcaa

SEQ ID NO: 14709 - DNA, 25 bp, Homo sapiens
aagaacagagaagagcaagtccaga

SEQ ID NO: 14710 - DNA, 24 bp, Homo sapiens
actgagtctagctgcgtctggagg

SEQ ID NO: 14711 - DNA, 25 bp, Homo sapiens
cgaggtgcaaataaagaacatagga

SEQ ID NO: 14712 - DNA, 23 bp, Homo sapiens
attaagattctgcttaatgctgg

SEQ ID NO: 14713 - DNA, 25 bp, Homo sapiens
cctgatgttggctgcaatgaatgga

SEQ ID NO: 14714 - DNA, 23 bp, Homo sapiens
ccaatcggaacacggctctcacc

SEQ ID NO: 14715 - DNA, 25 bp, Homo sapiens
agtagtgagtttgcttctggaccga

SEQ ID NO: 14716 - DNA, 25 bp, Homo sapiens
agcagcagacaaaggtcactacaaa

SEQ ID NO: 14717 - DNA, 25 bp, Homo sapiens
tgtgccttcctcaagagatactgct

SEQ ID NO: 14718 - DNA, 24 bp, Homo sapiens
gttgaacatagggcaaagacgggt

SEQ ID NO: 14719 - DNA, 25 bp, Homo sapiens
catatcagaacacctgccagcacca

SEQ ID NO: 14720 - DNA, 23 bp, Homo sapiens
gcaacagattcggcatcctcgct

SEQ ID NO: 14721 - DNA, 25 bp, Homo sapiens
aaccttctcaccttctcctaacaca

SEQ ID NO: 14722 - DNA, 24 bp, Homo sapiens
ttcaaacgattctcctgcctcagc

SEQ ID NO: 14723 - DNA, 24 bp, Homo sapiens
gttcaaacgattctcctgcctcag

SEQ ID NO: 14724 - DNA, 24 bp, Homo sapiens
ggttcaaacgattctcctgcctca

SEQ ID NO: 14725 - DNA, 24 bp, Homo sapiens
ttcaaacgattctcctgcctcagc

SEQ ID NO: 14726 - DNA, 24 bp, Homo sapiens
gttcaaacgattctcctgcctcag

SEQ ID NO: 14727 - DNA, 24 bp, Homo sapiens
ggttcaaacgattctcctgcctca

SEQ ID NO: 14728 - DNA, 25 bp, Homo sapiens
gcacaaagagaaagtaaagaagccc

SEQ ID NO: 14729 - DNA, 25 bp, Homo sapiens
ggcagagtgttcccttatgttgaag

SEQ ID NO: 14730 - DNA, 23 bp, Homo sapiens
aggtctgtgccactgaacatcca

SEQ ID NO: 14731 - DNA, 24 bp, Homo sapiens
aaatgtctcaggcaaaaatagaca

SEQ ID NO: 14732 - DNA, 24 bp, Homo sapiens
gaaatgtctcaggcaaaaatagac

SEQ ID NO: 14733 - DNA, 24 bp, Homo sapiens
tgaaatgtctcaggcaaaaataga

SEQ ID NO: 14734 - DNA, 24 bp, Homo sapiens
ctccagcctcagcctcctgagtac

SEQ ID NO: 14735 - DNA, 24 bp, Homo sapiens
gaactcggaagaggactaccccaa

SEQ ID NO: 14736 - DNA, 24 bp, Homo sapiens
tgaactcggaagaggactacccca

SEQ ID NO: 14737 - DNA, 24 bp, Homo sapiens
ctgaactcggaagaggactacccc

SEQ ID NO: 14738 - DNA, 24 bp, Homo sapiens
gccatccagattcagtgagcggtg

SEQ ID NO: 14739 - DNA, 23 bp, Homo sapiens
tctgctgaagtgcgtctgaaggc

SEQ ID NO: 14740 - DNA, 23 bp, Homo sapiens
ttgagtcctgctgttggtgtcgg

SEQ ID NO: 14741 - DNA, 24 bp, Homo sapiens
ctacaacctctgcctcccaggttc

SEQ ID NO: 14742 - DNA, 24 bp, Homo sapiens
actacaacctctgcctcccaggtt

SEQ ID NO: 14743 - DNA, 24 bp, Homo sapiens
cactacaacctctgcctcccaggt

SEQ ID NO: 14744 - DNA, 23 bp, Homo sapiens
ccaagatgcacgtccgcttcctt

SEQ ID NO: 14745 - DNA, 23 bp, Homo sapiens
gaaaccatggccctctgccactg

SEQ ID NO: 14746 - DNA, 25 bp, Homo sapiens
ccactcctctgctgctattccctga

SEQ ID NO: 14747 - DNA, 25 bp, Homo sapiens
aagagattctgtgcttccacgaggc

SEQ ID NO: 14748 - DNA, 25 bp, Homo sapiens
cttgctttctcttctcctggttccc

SEQ ID NO: 14749 - DNA, 23 bp, Homo sapiens
ctcctctgctgctattccctgag

SEQ ID NO: 14750 - DNA, 25 bp, Homo sapiens
agattctgtgcttccacgaggcttc

SEQ ID NO: 14751 - DNA, 25 bp, Homo sapiens
cttgctttctcttctcctggttccc

SEQ ID NO: 14752 - DNA, 24 bp, Homo sapiens
gagctcatcaggtggtggaagatg

SEQ ID NO: 14753 - DNA, 24 bp, Homo sapiens
cgagctcatcaggtggtggaagat

SEQ ID NO: 14754 - DNA, 24 bp, Homo sapiens
tcgagctcatcaggtggtggaaga

SEQ ID NO: 14755 - DNA, 25 bp, Homo sapiens
acacctttaacttaaggagacgggt

SEQ ID NO: 14756 - DNA, 25 bp, Homo sapiens
aaccatccagccatttgacaccctt

SEQ ID NO: 14757 - DNA, 25 bp, Homo sapiens
agaaaccatcagatttgttaaggac

SEQ ID NO: 14758 - DNA, 25 bp, Homo sapiens
atgctggtggaatgatgagtgtgga

SEQ ID NO: 14759 - DNA, 25 bp, Homo sapiens
ttgctaaacgacagttggtaacctt

SEQ ID NO: 14760 - DNA, 23 bp, Homo sapiens
agccccaaattactgtggcgagt

SEQ ID NO: 14761 - DNA, 24 bp, Homo sapiens
aattctcctgcctcaaccttccga

SEQ ID NO: 14762 - DNA, 24 bp, Homo sapiens
caattctcctgcctcaaccttccg

SEQ ID NO: 14763 - DNA, 24 bp, Homo sapiens
gcaattctcctgcctcaaccttcc

SEQ ID NO: 14764 - DNA, 25 bp, Homo sapiens
gtgggatctggcaagaggagtcaaa

SEQ ID NO: 14765 - DNA, 25 bp, Homo sapiens
accacacccgttcgatcctagagtt

SEQ ID NO: 14766 - DNA, 23 bp, Homo sapiens
tctgctggtcatgatggaaacgt

SEQ ID NO: 14767 - DNA, 25 bp, Homo sapiens
tcagtggtggaacatccgaagaaga

SEQ ID NO: 14768 - DNA, 24 bp, Homo sapiens
ttttgattcagattggcccaagag

SEQ ID NO: 14769 - DNA, 24 bp, Homo sapiens
tttttgattcagattggcccaaga

SEQ ID NO: 14770 - DNA, 24 bp, Homo sapiens
ctttttgattcagattggcccaag

SEQ ID NO: 14771 - DNA, 25 bp, Homo sapiens
ggagtaggaagtaatatgagcagga

SEQ ID NO: 14772 - DNA, 24 bp, Homo sapiens
gccagaacaaccaacctgcgtatg

SEQ ID NO: 14773 - DNA, 25 bp, Homo sapiens
ccgtaacctctgcctcctaagtagc

SEQ ID NO: 14774 - DNA, 23 bp, Homo sapiens
gcagtctcactctgtcaccaggc

SEQ ID NO: 14775 - DNA, 23 bp, Homo sapiens
atctcctgacctcgtgatctgcc

SEQ ID NO: 14776 - DNA, 24 bp, Homo sapiens
ccattccgtagacctcctggcatt

SEQ ID NO: 14777 - DNA, 24 bp, Homo sapiens
tccattccgtagacctcctggcat

SEQ ID NO: 14778 - DNA, 24 bp, Homo sapiens
ttccattccgtagacctcctggca

SEQ ID NO: 14779 - DNA, 24 bp, Homo sapiens
catcgtgccaggtaggggctgggg

SEQ ID NO: 14780 - DNA, 24 bp, Homo sapiens
gcatcgtgccaggtaggggctggg

SEQ ID NO: 14781 - DNA, 24 bp, Homo sapiens
cgcatcgtgccaggtaggggctgg

SEQ ID NO: 14782 - DNA, 24 bp, Homo sapiens
cagcgaaaaattcgacagcaagaa

SEQ ID NO: 14783 - DNA, 24 bp, Homo sapiens
gcagcgaaaaattcgacagcaaga

SEQ ID NO: 14784 - DNA, 24 bp, Homo sapiens
ggcagcgaaaaattcgacagcaag

SEQ ID NO: 14785 - DNA, 24 bp, Homo sapiens
tgagaacaaaggtgaaatgtctag

SEQ ID NO: 14786 - DNA, 24 bp, Homo sapiens
ctgagaacaaaggtgaaatgtcta

SEQ ID NO: 14787 - DNA, 24 bp, Homo sapiens
actgagaacaaaggtgaaatgtct

SEQ ID NO: 14788 - DNA, 25 bp, Homo sapiens
agacattaactctcacgtcatcaaa

SEQ ID NO: 14789 - DNA, 24 bp, Homo sapiens
tgggcacaaaacaaattaaaagct

SEQ ID NO: 14790 - DNA, 23 bp, Homo sapiens
ctcatcagagaaatagacaaatt

SEQ ID NO: 14791 - DNA, 24 bp, Homo sapiens
gatgatggaggttgacaggcgggt

SEQ ID NO: 14792 - DNA, 24 bp, Homo sapiens
agatgatggaggttgacaggcggg

SEQ ID NO: 14793 - DNA, 24 bp, Homo sapiens
gagatgatggaggttgacaggcgg

SEQ ID NO: 14794 - DNA, 24 bp, Homo sapiens
acaaacaacaggttcctacaaact

SEQ ID NO: 14795 - DNA, 24 bp, Homo sapiens
aacaaacaacaggttcctacaaac

SEQ ID NO: 14796 - DNA, 24 bp, Homo sapiens
taacaaacaacaggttcctacaaa

SEQ ID NO: 14797 - DNA, 23 bp, Homo sapiens
gcgatcctcctgcctcagcctcc

SEQ ID NO: 14798 - DNA, 25 bp, Homo sapiens
gcctacagagtgccccaattttcag

SEQ ID NO: 14799 - DNA, 23 bp, Homo sapiens
aaccttcatgcacttatggcagt

SEQ ID NO: 14800 - DNA, 24 bp, Homo sapiens
tctatggcatggaccttctctggc

SEQ ID NO: 14801 - DNA, 23 bp, Homo sapiens
gacccttgcctcctccctctcct

SEQ ID NO: 14802 - DNA, 24 bp, Homo sapiens
cccaacacacggtacacctttgcc

SEQ ID NO: 14803 - DNA, 23 bp, Homo sapiens
acctccgccttccagtttcaagc

SEQ ID NO: 14804 - DNA, 24 bp, Homo sapiens
atctcaagcagaacaacacagcta

SEQ ID NO: 14805 - DNA, 24 bp, Homo sapiens
catctcaagcagaacaacacagct

SEQ ID NO: 14806 - DNA, 24 bp, Homo sapiens
ccatctcaagcagaacaacacagc

SEQ ID NO: 14807 - DNA, 24 bp, Homo sapiens
ccagcctgctgagaaagataagaa

SEQ ID NO: 14808 - DNA, 24 bp, Homo sapiens
cccagcctgctgagaaagataaga

SEQ ID NO: 14809 - DNA, 24 bp, Homo sapiens
acccagcctgctgagaaagataag

SEQ ID NO: 14810 - DNA, 24 bp, Homo sapiens
tctttccccaggactagagctgga

SEQ ID NO: 14811 - DNA, 24 bp, Homo sapiens
ttctttccccaggactagagctgg

SEQ ID NO: 14812 - DNA, 24 bp, Homo sapiens
cttctttccccaggactagagctg

SEQ ID NO: 14813 - DNA, 24 bp, Homo sapiens
gcaagtcaagtgaggatgaagagc

SEQ ID NO: 14814 - DNA, 24 bp, Homo sapiens
acccttcctgagcgacctttgaca

SEQ ID NO: 14815 - DNA, 24 bp, Homo sapiens
ccaagtctcttcgcaccacagcac

SEQ ID NO: 14816 - DNA, 24 bp, Homo sapiens
ttggtgcctgtgaagaagaatgcc

SEQ ID NO: 14817 - DNA, 24 bp, Homo sapiens
gtggtggtttctgacaagtacaac

SEQ ID NO: 14818 - DNA, 24 bp, Homo sapiens
acccttcctgagcgacctttgaca

SEQ ID NO: 14819 - DNA, 24 bp, Homo sapiens
ccaagtctcttcgcaccacagcac

SEQ ID NO: 14820 - DNA, 24 bp, Homo sapiens
ttggtgcctgtgaagaagaatgcc

SEQ ID NO: 14821 - DNA, 24 bp, Homo sapiens
ccaagtctcttcgcaccacagcac

SEQ ID NO: 14822 - DNA, 24 bp, Homo sapiens
ttgacagaggtgaaggctgagacc

SEQ ID NO: 14823 - DNA, 24 bp, Homo sapiens
aaaagtcgaactacccttcctgag

SEQ ID NO: 14824 - DNA, 24 bp, Homo sapiens
ttggtgcctgtgaagaagaatgcc

SEQ ID NO: 14825 - DNA, 24 bp, Homo sapiens
caagtctcttcgcaccacagcacc

SEQ ID NO: 14826 - DNA, 24 bp, Homo sapiens
gcaagtcaagtgaggatgaagagc

SEQ ID NO: 14827 - DNA, 24 bp, Homo sapiens
tcaacacaacacctaatgccacca

SEQ ID NO: 14828 - DNA, 24 bp, Homo sapiens
ttggtgcctgtgaagaagaatgcc

SEQ ID NO: 14829 - DNA, 24 bp, Homo sapiens
ccaagtctcttcgcaccacagcac

SEQ ID NO: 14830 - DNA, 24 bp, Homo sapiens
aaggaagaggtggcagtgctgatt

SEQ ID NO: 14831 - DNA, 23 bp, Homo sapiens
atacctcttcactcaggctctgc

SEQ ID NO: 14832 - DNA, 24 bp, Homo sapiens
ttgccttaccaaatctccaggttt

SEQ ID NO: 14833 - DNA, 24 bp, Homo sapiens
acccggaactgatctgacaggatg

SEQ ID NO: 14834 - DNA, 24 bp, Homo sapiens
gacccggaactgatctgacaggat

SEQ ID NO: 14835 - DNA, 24 bp, Homo sapiens
ggacccggaactgatctgacagga

SEQ ID NO: 14836 - DNA, 24 bp, Homo sapiens
actggcagaaggcgctggaatcca

SEQ ID NO: 14837 - DNA, 24 bp, Homo sapiens
aactggcagaaggcgctggaatcc

SEQ ID NO: 14838 - DNA, 24 bp, Homo sapiens
aaactggcagaaggcgctggaatc

SEQ ID NO: 14839 - DNA, 24 bp, Homo sapiens
agctctgactgctctgagtccagc

SEQ ID NO: 14840 - DNA, 24 bp, Homo sapiens
cagctctgactgctctgagtccag

SEQ ID NO: 14841 - DNA, 24 bp, Homo sapiens
gcagctctgactgctctgagtcca

SEQ ID NO: 14842 - DNA, 24 bp, Homo sapiens
aaaaagaagaggatgagcaacaaa

SEQ ID NO: 14843 - DNA, 24 bp, Homo sapiens
aaaaaagaagaggatgagcaacaa

SEQ ID NO: 14844 - DNA, 24 bp, Homo sapiens
taaaaaagaagaggatgagcaaca

SEQ ID NO: 14845 - DNA, 25 bp, Homo sapiens
cggaactgatctgacaggatggcat

SEQ ID NO: 14846 - DNA, 25 bp, Homo sapiens
cccacaacatactcaaaggaacgga

SEQ ID NO: 14847 - DNA, 25 bp, Homo sapiens
tgacatagtgattgaggccatgctg

SEQ ID NO: 14848 - DNA, 24 bp, Homo sapiens
gatcggaactcacgtcgttctaag

SEQ ID NO: 14849 - DNA, 24 bp, Homo sapiens
agatcggaactcacgtcgttctaa

SEQ ID NO: 14850 - DNA, 24 bp, Homo sapiens
cagatcggaactcacgtcgttcta

SEQ ID NO: 14851 - DNA, 23 bp, Homo sapiens
gcaccgactggtagtgatgagcc

SEQ ID NO: 14852 - DNA, 25 bp, Homo sapiens
gactacacttcacctccacagttgt

SEQ ID NO: 14853 - DNA, 25 bp, Homo sapiens
cgcctacacgcccacttattctctc

SEQ ID NO: 14854 - DNA, 25 bp, Homo sapiens
gactacacttcacctccacagttgt

SEQ ID NO: 14855 - DNA, 25 bp, Homo sapiens
tgctgtttgccatcgtttgtccatc

SEQ ID NO: 14856 - DNA, 25 bp, Homo sapiens
cgcctacacgcccacttattctctc

SEQ ID NO: 14857 - DNA, 25 bp, Homo sapiens
atcggcagaacttacccaatctcat

SEQ ID NO: 14858 - DNA, 24 bp, Homo sapiens
cgttaccgaggacagtacagcagc

SEQ ID NO: 14859 - DNA, 25 bp, Homo sapiens
aactcttctacacctccaacatccc

SEQ ID NO: 14860 - DNA, 24 bp, Homo sapiens
ccccgagtgtccagtgctgtgaag

SEQ ID NO: 14861 - DNA, 24 bp, Homo sapiens
cccccgagtgtccagtgctgtgaa

SEQ ID NO: 14862 - DNA, 24 bp, Homo sapiens
acccccgagtgtccagtgctgtga

SEQ ID NO: 14863 - DNA, 24 bp, Homo sapiens
acagtggaggagacagtggtgcgg

SEQ ID NO: 14864 - DNA, 24 bp, Homo sapiens
catctcacacgagcactcgccctc

SEQ ID NO: 14865 - DNA, 24 bp, Homo sapiens
gtgaggccgaggtgagggccgcag

SEQ ID NO: 14866 - DNA, 24 bp, Homo sapiens
tgtgaggccgaggtgagggccgca

SEQ ID NO: 14867 - DNA, 24 bp, Homo sapiens
ctgtgaggccgaggtgagggccgc

SEQ ID NO: 14868 - DNA, 24 bp, Homo sapiens
caaggtgctggagctggacaacgt

SEQ ID NO: 14869 - DNA, 24 bp, Homo sapiens
cggtggaggcgtgcgtgaacatcg

SEQ ID NO: 14870 - DNA, 24 bp, Homo sapiens
ccgctacatggtggctgacaagtt

SEQ ID NO: 14871 - DNA, 24 bp, Homo sapiens
cattgtggagctggctgaggacgc

SEQ ID NO: 14872 - DNA, 24 bp, Homo sapiens
tctctaacctggactgtgtgaacg

SEQ ID NO: 14873 - DNA, 24 bp, Homo sapiens
gcggctggccatcattgagtacat

SEQ ID NO: 14874 - DNA, 24 bp, Homo sapiens
gctgggagtggagttctttgatga

SEQ ID NO: 14875 - DNA, 24 bp, Homo sapiens
cattgtggagctggctgaggacgc

SEQ ID NO: 14876 - DNA, 24 bp, Homo sapiens
tccctgccttccagaacctgatga

SEQ ID NO: 14877 - DNA, 24 bp, Homo sapiens
gacatcgagaaaatcaccgaagat

SEQ ID NO: 14878 - DNA, 24 bp, Homo sapiens
cgacatcgagaaaatcaccgaaga

SEQ ID NO: 14879 - DNA, 24 bp, Homo sapiens
gcgacatcgagaaaatcaccgaag

SEQ ID NO: 14880 - DNA, 24 bp, Homo sapiens
tcatctgcatggactcgtactcga

SEQ ID NO: 14881 - DNA, 24 bp, Homo sapiens
ctcatctgcatggactcgtactcg

SEQ ID NO: 14882 - DNA, 24 bp, Homo sapiens
cctcatctgcatggactcgtactc

SEQ ID NO: 14883 - DNA, 23 bp, Homo sapiens
cgttgtgctcggtgctgtttgca

SEQ ID NO: 14884 - DNA, 24 bp, Homo sapiens
aagtaggagatgatacttcctctt

SEQ ID NO: 14885 - DNA, 23 bp, Homo sapiens
gaacatttcctgagctcctgtgt

SEQ ID NO: 14886 - DNA, 25 bp, Homo sapiens
gctccatgcttctcacggctatgtc

SEQ ID NO: 14887 - DNA, 24 bp, Homo sapiens
gcacagcaagtgaaattcccgtcg

SEQ ID NO: 14888 - DNA, 23 bp, Homo sapiens
cagcccagcacccctacgcccat

SEQ ID NO: 14889 - DNA, 25 bp, Homo sapiens
cctcctgttgtctgcttccatcaag

SEQ ID NO: 14890 - DNA, 23 bp, Homo sapiens
atctgccaccgatgacctccacc

SEQ ID NO: 14891 - DNA, 24 bp, Homo sapiens
cggaggaagcaagatgaagggcag

SEQ ID NO: 14892 - DNA, 23 bp, Homo sapiens
gactgaatgctcggattgggaaa

SEQ ID NO: 14893 - DNA, 24 bp, Homo sapiens
cctttctgcgagtacgagccaacc

SEQ ID NO: 14894 - DNA, 23 bp, Homo sapiens
atctgccaccgatgacctccacc

SEQ ID NO: 14895 - DNA, 23 bp, Homo sapiens
gctgaggatgatgctgtggacat

SEQ ID NO: 14896 - DNA, 24 bp, Homo sapiens
tgagaacaacaaccgctttgagga

SEQ ID NO: 14897 - DNA, 24 bp, Homo sapiens
gtggtgtggacagaagcggatacg

SEQ ID NO: 14898 - DNA, 23 bp, Homo sapiens
ggtcagagaacttgaacggcagc

SEQ ID NO: 14899 - DNA, 25 bp, Homo sapiens
ggaccgttacaaatgcctcatctgc

SEQ ID NO: 14900 - DNA, 23 bp, Homo sapiens
ctgcggaggatctacttgtgagc

SEQ ID NO: 14901 - DNA, 24 bp, Homo sapiens
tagaggtcaagcttttcacatcct

SEQ ID NO: 14902 - DNA, 24 bp, Homo sapiens
atagaggtcaagcttttcacatcc

SEQ ID NO: 14903 - DNA, 24 bp, Homo sapiens
catagaggtcaagcttttcacatc

SEQ ID NO: 14904 - DNA, 24 bp, Homo sapiens
ctgtcctggaggtaatgatgcaaa

SEQ ID NO: 14905 - DNA, 24 bp, Homo sapiens
cctgtcctggaggtaatgatgcaa

SEQ ID NO: 14906 - DNA, 24 bp, Homo sapiens
acctgtcctggaggtaatgatgca

SEQ ID NO: 14907 - DNA, 24 bp, Homo sapiens
cgatttttcaggttttgtgtggct

SEQ ID NO: 14908 - DNA, 24 bp, Homo sapiens
ccgatttttcaggttttgtgtggc

SEQ ID NO: 14909 - DNA, 24 bp, Homo sapiens
gccgatttttcaggttttgtgtgg

SEQ ID NO: 14910 - DNA, 24 bp, Homo sapiens
aggatgtacaggtggacaatcagc

SEQ ID NO: 14911 - DNA, 24 bp, Homo sapiens
caggatgtacaggtggacaatcag

SEQ ID NO: 14912 - DNA, 24 bp, Homo sapiens
acaggatgtacaggtggacaatca

SEQ ID NO: 14913 - DNA, 23 bp, Homo sapiens
aagaacagcagcaccacccaagg

SEQ ID NO: 14914 - DNA, 25 bp, Homo sapiens
gatatggtgaatgtaagtctggagc

SEQ ID NO: 14915 - DNA, 25 bp, Homo sapiens
catactgtcctgagtggagaagtgt

SEQ ID NO: 14916 - DNA, 23 bp, Homo sapiens
gcagtgactatggaaggcagtgc

SEQ ID NO: 14917 - DNA, 25 bp, Homo sapiens
ggaacagacttgagacaccaatgga

SEQ ID NO: 14918 - DNA, 24 bp, Homo sapiens
agtggtgcttcctgctatcatgcc

SEQ ID NO: 14919 - DNA, 25 bp, Homo sapiens
tgagacctggttctggaatgttatc

SEQ ID NO: 14920 - DNA, 24 bp, Homo sapiens
gccagttccacctgaacaacaatt

SEQ ID NO: 14921 - DNA, 24 bp, Homo sapiens
ggtttgtttgatggagctgaagtt

SEQ ID NO: 14922 - DNA, 25 bp, Homo sapiens
tgtctgtgaatcacggtattctgcc

SEQ ID NO: 14923 - DNA, 23 bp, Homo sapiens
ggatgtgcctctgcctgtggttc

SEQ ID NO: 14924 - DNA, 25 bp, Homo sapiens
atacagacaactcagaggacagtcg

SEQ ID NO: 14925 - DNA, 25 bp, Homo sapiens
cagcatgatctcttcagccacctct

SEQ ID NO: 14926 - DNA, 23 bp, Homo sapiens
gccaggagagacgatatcgagga

SEQ ID NO: 14927 - DNA, 25 bp, Homo sapiens
gtctgtgaatcacggtattctgcca

SEQ ID NO: 14928 - DNA, 23 bp, Homo sapiens
ggatgtgcctctgcctgtggttc

SEQ ID NO: 14929 - DNA, 25 bp, Homo sapiens
atacagacaactcagaggacagtcg

SEQ ID NO: 14930 - DNA, 24 bp, Homo sapiens
cttcccaccaggcatccggtcttg

SEQ ID NO: 14931 - DNA, 24 bp, Homo sapiens
ccttcccaccaggcatccggtctt

SEQ ID NO: 14932 - DNA, 24 bp, Homo sapiens
tccttcccaccaggcatccggtct

SEQ ID NO: 14933 - DNA, 24 bp, Homo sapiens
tcaactgccaaaggtgtgttgcag

SEQ ID NO: 14934 - DNA, 24 bp, Homo sapiens
ttcaactgccaaaggtgtgttgca

SEQ ID NO: 14935 - DNA, 24 bp, Homo sapiens
tttcaactgccaaaggtgtgttgc

SEQ ID NO: 14936 - DNA, 24 bp, Homo sapiens
taaatgtgaggcagcctccatcta

SEQ ID NO: 14937 - DNA, 24 bp, Homo sapiens
ttaaatgtgaggcagcctccatct

SEQ ID NO: 14938 - DNA, 24 bp, Homo sapiens
attaaatgtgaggcagcctccatc

SEQ ID NO: 14939 - DNA, 24 bp, Homo sapiens
cagttcagcagcagcagcctccat

SEQ ID NO: 14940 - DNA, 24 bp, Homo sapiens
tcagttcagcagcagcagcctcca

SEQ ID NO: 14941 - DNA, 24 bp, Homo sapiens
gtcagttcagcagcagcagcctcc

SEQ ID NO: 14942 - DNA, 24 bp, Homo sapiens
tgggattacagatggtggagccag

SEQ ID NO: 14943 - DNA, 24 bp, Homo sapiens
ctgggattacagatggtggagcca

SEQ ID NO: 14944 - DNA, 24 bp, Homo sapiens
gctgggattacagatggtggagcc

SEQ ID NO: 14945 - DNA, 25 bp, Homo sapiens
acgagcattgtggtttagtgtttca

SEQ ID NO: 14946 - DNA, 25 bp, Homo sapiens
aggaaggacgatagcaggaatcatc

SEQ ID NO: 14947 - DNA, 25 bp, Homo sapiens
cctacctaatggagatcgtgctggc

SEQ ID NO: 14948 - DNA, 24 bp, Homo sapiens
agacaatgcagacttgttgagccc

SEQ ID NO: 14949 - DNA, 24 bp, Homo sapiens
aagacaatgcagacttgttgagcc

SEQ ID NO: 14950 - DNA, 24 bp, Homo sapiens
aaagacaatgcagacttgttgagc

SEQ ID NO: 14951 - DNA, 24 bp, Homo sapiens
tcctcttcctgccagtcctcttca

SEQ ID NO: 14952 - DNA, 24 bp, Homo sapiens
ttgctccttggctgagttgctgtc

SEQ ID NO: 14953 - DNA, 24 bp, Homo sapiens
gccaaggtccacagcctcaataca

SEQ ID NO: 14954 - DNA, 24 bp, Homo sapiens
tcacccaggagaagaggagtgtcg

SEQ ID NO: 14955 - DNA, 24 bp, Homo sapiens
gcctctgtctccagtcacaccacc

SEQ ID NO: 14956 - DNA, 24 bp, Homo sapiens
atggaagtctcgctatctgatgga

SEQ ID NO: 14957 - DNA, 24 bp, Homo sapiens
caaggtcctccgaagcagcgtgag

SEQ ID NO: 14958 - DNA, 24 bp, Homo sapiens
ccacatcagtagaacgactccgag

SEQ ID NO: 14959 - DNA, 24 bp, Homo sapiens
ccatcagattccagaggcacttct

SEQ ID NO: 14960 - DNA, 24 bp, Homo sapiens
tgtggtctttctcaggatggcttc

SEQ ID NO: 14961 - DNA, 24 bp, Homo sapiens
ctgtagaggaacgctgtggagaca

SEQ ID NO: 14962 - DNA, 24 bp, Homo sapiens
atccctcgttctgacctgaatggc

SEQ ID NO: 14963 - DNA, 24 bp, Homo sapiens
agacaatgcaggctcaaagagtcc

SEQ ID NO: 14964 - DNA, 24 bp, Homo sapiens
aagacaatgcaggctcaaagagtc

SEQ ID NO: 14965 - DNA, 24 bp, Homo sapiens
aaagacaatgcaggctcaaagagt

SEQ ID NO: 14966 - DNA, 24 bp, Homo sapiens
gcacagcaggcagaattgtcacaa

SEQ ID NO: 14967 - DNA, 24 bp, Homo sapiens
acaggaccagttcagcccaaagac

SEQ ID NO: 14968 - DNA, 24 bp, Homo sapiens
agccacctccagcaaagccttcta

SEQ ID NO: 14969 - DNA, 24 bp, Homo sapiens
tccagcagttaatgagaagagcgt

SEQ ID NO: 14970 - DNA, 24 bp, Homo sapiens
ctgtagaggaacgctgtggagaca

SEQ ID NO: 14971 - DNA, 24 bp, Homo sapiens
tggcttccttctcaactgtgacaa

SEQ ID NO: 14972 - DNA, 24 bp, Homo sapiens
aggttattagacttcatcggcgga

SEQ ID NO: 14973 - DNA, 24 bp, Homo sapiens
tggcttccttctcaactgtgacaa

SEQ ID NO: 14974 - DNA, 24 bp, Homo sapiens
acctacctggtgtccttgtggtct

SEQ ID NO: 14975 - DNA, 24 bp, Homo sapiens
gcaagagatttggctttggacact

SEQ ID NO: 14976 - DNA, 24 bp, Homo sapiens
acagcaatttgaggtcaatgggca

SEQ ID NO: 14977 - DNA, 24 bp, Homo sapiens
actttcggtaatgatgctcggttc

SEQ ID NO: 14978 - DNA, 23 bp, Homo sapiens
gcgattctcctgccttgacctcc

SEQ ID NO: 14979 - DNA, 23 bp, Homo sapiens
gcccaggctggtcttgaactcct

SEQ ID NO: 14980 - DNA, 25 bp, Homo sapiens
aagtgctaggattaaaggcgtgaat

SEQ ID NO: 14981 - DNA, 23 bp, Homo sapiens
tcaagtgatccacccgcctcggc

SEQ ID NO: 14982 - DNA, 23 bp, Homo sapiens
ttggccaggctagtctcgaactc

SEQ ID NO: 14983 - DNA, 25 bp, Homo sapiens
gagatccagccacatcagtggaagc

SEQ ID NO: 14984 - DNA, 25 bp, Homo sapiens
agagagaagaacaccggctcccatt

SEQ ID NO: 14985 - DNA, 24 bp, Homo sapiens
cagctgccagtcctaggaaaatgc

SEQ ID NO: 14986 - DNA, 23 bp, Homo sapiens
agcaagtggcttggatcctggcc

SEQ ID NO: 14987 - DNA, 25 bp, Homo sapiens
tgtatccagagttacttccagtgtg

SEQ ID NO: 14988 - DNA, 25 bp, Homo sapiens
aaggcaaagaatccccaggataaga

SEQ ID NO: 14989 - DNA, 25 bp, Homo sapiens
aatcagcaagtaccttctaacctgc

SEQ ID NO: 14990 - DNA, 25 bp, Homo sapiens
ccgccaactgacagtgagaatcaag

SEQ ID NO: 14991 - DNA, 25 bp, Homo sapiens
gtgaagagatccagccacatcagtg

SEQ ID NO: 14992 - DNA, 23 bp, Homo sapiens
gctccatcgcccttcaccatcag

SEQ ID NO: 14993 - DNA, 23 bp, Homo sapiens
cccaagtttcagaccctgttcca

SEQ ID NO: 14994 - DNA, 23 bp, Homo sapiens
taacttgatgggagctatgcagc

SEQ ID NO: 14995 - DNA, 24 bp, Homo sapiens
cctcattctaggtttgacttctgt

SEQ ID NO: 14996 - DNA, 24 bp, Homo sapiens
gcctcattctaggtttgacttctg

SEQ ID NO: 14997 - DNA, 24 bp, Homo sapiens
ggcctcattctaggtttgacttct

SEQ ID NO: 14998 - DNA, 23 bp, Homo sapiens
ggcgaggtagctcggtgcgtctc

SEQ ID NO: 14999 - DNA, 25 bp, Homo sapiens
tgaacacgaacactctaattgcctc

SEQ ID NO: 15000 - DNA, 25 bp, Homo sapiens
cctggcatgaggaagtggtacagtt

SEQ ID NO: 15001 - DNA, 24 bp, Homo sapiens
aagttcagcaagcagtcttaccat

SEQ ID NO: 15002 - DNA, 24 bp, Homo sapiens
caaggcccaagtgagcacgctgct

SEQ ID NO: 15003 - DNA, 24 bp, Homo sapiens
tcaaggcccaagtgagcacgctgc

SEQ ID NO: 15004 - DNA, 24 bp, Homo sapiens
ttcaaggcccaagtgagcacgctg

SEQ ID NO: 15005 - DNA, 24 bp, Homo sapiens
acccactaccgcctgcccagtgtc

SEQ ID NO: 15006 - DNA, 24 bp, Homo sapiens
cacccactaccgcctgcccagtgt

SEQ ID NO: 15007 - DNA, 24 bp, Homo sapiens
acacccactaccgcctgcccagtg

SEQ ID NO: 15008 - DNA, 23 bp, Homo sapiens
cgtcagtgttgcgtcctctttga

SEQ ID NO: 15009 - DNA, 25 bp, Homo sapiens
tcacagagcctatttacccagaagt

SEQ ID NO: 15010 - DNA, 25 bp, Homo sapiens
ttaccaccttcctccaatcctacgg

SEQ ID NO: 15011 - DNA, 25 bp, Homo sapiens
tgaaagaacgggaagaagcatgggt

SEQ ID NO: 15012 - DNA, 24 bp, Homo sapiens
ttccttccttgtaccgcaactcaa

SEQ ID NO: 15013 - DNA, 25 bp, Homo sapiens
tcagtgacaacgcagcgaagattct

SEQ ID NO: 15014 - DNA, 23 bp, Homo sapiens
cgtcagtgttgcgtcctctttga

SEQ ID NO: 15015 - DNA, 23 bp, Homo sapiens
ccagcccgtggtccttctccata

SEQ ID NO: 15016 - DNA, 25 bp, Homo sapiens
tgtaataaagcgggcagcaggatgg

SEQ ID NO: 15017 - DNA, 23 bp, Homo sapiens
ccagcccgtggtccttctccata

SEQ ID NO: 15018 - DNA, 25 bp, Homo sapiens
tgtaataaagcgggcagcaggatgg

SEQ ID NO: 15019 - DNA, 23 bp, Homo sapiens
cccattgcctttcccgctgaagt

SEQ ID NO: 15020 - DNA, 23 bp, Homo sapiens
cgtcagtgttgcgtcctctttga

SEQ ID NO: 15021 - DNA, 25 bp, Homo sapiens
tcacagagcctatttacccagaagt

SEQ ID NO: 15022 - DNA, 25 bp, Homo sapiens
aacattaccaccttcctccaatcct

SEQ ID NO: 15023 - DNA, 24 bp, Homo sapiens
gcatcataatggcatagcagagtt

SEQ ID NO: 15024 - DNA, 25 bp, Homo sapiens
gaaatctctgagtgtctaccatccc

SEQ ID NO: 15025 - DNA, 25 bp, Homo sapiens
gccttaccactaaaagaagagcaca

SEQ ID NO: 15026 - DNA, 25 bp, Homo sapiens
acagagcatcataatggcatagcag

SEQ ID NO: 15027 - DNA, 25 bp, Homo sapiens
tgacagtgaagatcctcgggagaga

SEQ ID NO: 15028 - DNA, 25 bp, Homo sapiens
gaaatctctgagtgtctaccatccc

SEQ ID NO: 15029 - DNA, 25 bp, Homo sapiens
tgacagtgaagatcctcgggagaga

SEQ ID NO: 15030 - DNA, 25 bp, Homo sapiens
ttaccaccttcctccaatcctacgg

SEQ ID NO: 15031 - DNA, 25 bp, Homo sapiens
accacccttcacagaatctatggga

SEQ ID NO: 15032 - DNA, 25 bp, Homo sapiens
ttaccaccttcctccaatcctacgg

SEQ ID NO: 15033 - DNA, 25 bp, Homo sapiens
tgacagtgaagatcctcgggagaga

SEQ ID NO: 15034 - DNA, 25 bp, Homo sapiens
acagagcatcataatggcatagcag

SEQ ID NO: 15035 - DNA, 23 bp, Homo sapiens
cctgactcagcctcccaagtagc

SEQ ID NO: 15036 - DNA, 23 bp, Homo sapiens
atgcaatggtgcgatctcggctc

SEQ ID NO: 15037 - DNA, 23 bp, Homo sapiens
gcctccgcctcccagcttcaagc

SEQ ID NO: 15038 - DNA, 23 bp, Homo sapiens
ccgtgcctcagccttccgagtag

SEQ ID NO: 15039 - DNA, 23 bp, Homo sapiens
agctcactgcaacctccacttcc

SEQ ID NO: 15040 - DNA, 23 bp, Homo sapiens
ttcaccagggacagtggcacacg

SEQ ID NO: 15041 - DNA, 24 bp, Homo sapiens
ctgacctcaagtgatccacctgcc

SEQ ID NO: 15042 - DNA, 25 bp, Homo sapiens
ttacaagtgtgagccaccgtacctg

SEQ ID NO: 15043 - DNA, 25 bp, Homo sapiens
aggctggagtgtagtggtacaatct

SEQ ID NO: 15044 - DNA, 24 bp, Homo sapiens
gctcagcatcagaggctccttgaa

SEQ ID NO: 15045 - DNA, 25 bp, Homo sapiens
ttcagcaatctcaagaacagaagga

SEQ ID NO: 15046 - DNA, 25 bp, Homo sapiens
aaagtgtttggaggaagaaaggcaa

SEQ ID NO: 15047 - DNA, 23 bp, Homo sapiens
ctggtcacgaagccctcagcatt

SEQ ID NO: 15048 - DNA, 25 bp, Homo sapiens
ttgcccttgtggatgattctgagga

SEQ ID NO: 15049 - DNA, 25 bp, Homo sapiens
aagcacagattcagcaatcaacaca

SEQ ID NO: 15050 - DNA, 25 bp, Homo sapiens
gtcctcatcctcatcgcaaccttgg

SEQ ID NO: 15051 - DNA, 24 bp, Homo sapiens
gaagagcaatggagggtcgagcac

SEQ ID NO: 15052 - DNA, 25 bp, Homo sapiens
gctggatgaggttgatatgtcagat

SEQ ID NO: 15053 - DNA, 23 bp, Homo sapiens
caccgtggccatgaagctatgca

SEQ ID NO: 15054 - DNA, 24 bp, Homo sapiens
aatggtcctcatcctcatcgcaac

SEQ ID NO: 15055 - DNA, 23 bp, Homo sapiens
gtggcccagctgctcctggtgca

SEQ ID NO: 15056 - DNA, 25 bp, Homo sapiens
cctccaagatacaagagaacgcatt

SEQ ID NO: 15057 - DNA, 23 bp, Homo sapiens
tcagccgagtggagccatcagac

SEQ ID NO: 15058 - DNA, 25 bp, Homo sapiens
atcagtgagcagattgtcattggca

SEQ ID NO: 15059 - DNA, 23 bp, Homo sapiens
aagtgatccgcctgtctcagcct

SEQ ID NO: 15060 - DNA, 23 bp, Homo sapiens
gtgttgggattacaggcatgagc

SEQ ID NO: 15061 - DNA, 23 bp, Homo sapiens
ggccagactggtctcgaactcct

SEQ ID NO: 15062 - DNA, 25 bp, Homo sapiens
cactatctcggctcactgcaacctc

SEQ ID NO: 15063 - DNA, 23 bp, Homo sapiens
ggctgatctcgaactcctcacct

SEQ ID NO: 15064 - DNA, 23 bp, Homo sapiens
aactgcctgcctcggcctccaaa

SEQ ID NO: 15065 - DNA, 24 bp, Homo sapiens
cgaaccatcgaacggaatcaggaa

SEQ ID NO: 15066 - DNA, 24 bp, Homo sapiens
cctgaagatgtggatacctgggct

SEQ ID NO: 15067 - DNA, 24 bp, Homo sapiens
ttggagcaaaggtcacaaatgagt

SEQ ID NO: 15068 - DNA, 23 bp, Homo sapiens
ggattacagacgcacaccaccat

SEQ ID NO: 15069 - DNA, 24 bp, Homo sapiens
caattcacctgcctcagcctcctg

SEQ ID NO: 15070 - DNA, 25 bp, Homo sapiens
aaagtgctgggattacaggcgtgag

SEQ ID NO: 15071 - DNA, 24 bp, Homo sapiens
tgggactacaggtttgtgccacta

SEQ ID NO: 15072 - DNA, 24 bp, Homo sapiens
ctgggactacaggtttgtgccact

SEQ ID NO: 15073 - DNA, 24 bp, Homo sapiens
gctgggactacaggtttgtgccac

SEQ ID NO: 15074 - DNA, 25 bp, Homo sapiens
tttccggcatcccaatattacaact

SEQ ID NO: 15075 - DNA, 24 bp, Homo sapiens
tgttggcagctggctttgggttat

SEQ ID NO: 15076 - DNA, 24 bp, Homo sapiens
tggcattacaggtgtggatgtgtg

SEQ ID NO: 15077 - DNA, 24 bp, Homo sapiens
ctggcattacaggtgtggatgtgt

SEQ ID NO: 15078 - DNA, 24 bp, Homo sapiens
gctggcattacaggtgtggatgtg

SEQ ID NO: 15079 - DNA, 23 bp, Homo sapiens
tattcgtccaccgcctccactcc

SEQ ID NO: 15080 - DNA, 24 bp, Homo sapiens
gtgaggatgaacttgcttggctaa

SEQ ID NO: 15081 - DNA, 25 bp, Homo sapiens
tgtgttaagaatagcactggtgtgg

SEQ ID NO: 15082 - DNA, 23 bp, Homo sapiens
aggttgattacagcggcctcagg

SEQ ID NO: 15083 - DNA, 24 bp, Homo sapiens
atatgcagcagtatcaacatgcaa

SEQ ID NO: 15084 - DNA, 24 bp, Homo sapiens
tatatgcagcagtatcaacatgca

SEQ ID NO: 15085 - DNA, 24 bp, Homo sapiens
ttatatgcagcagtatcaacatgc

SEQ ID NO: 15086 - DNA, 24 bp, Homo sapiens
tggactatctgatgaagaatgccg

SEQ ID NO: 15087 - DNA, 24 bp, Homo sapiens
atggactatctgatgaagaatgcc

SEQ ID NO: 15088 - DNA, 24 bp, Homo sapiens
catggactatctgatgaagaatgc

SEQ ID NO: 15089 - DNA, 24 bp, Homo sapiens
ctctagcccaggtagtccaaagaa

SEQ ID NO: 15090 - DNA, 24 bp, Homo sapiens
actctagcccaggtagtccaaaga

SEQ ID NO: 15091 - DNA, 24 bp, Homo sapiens
cactctagcccaggtagtccaaag

SEQ ID NO: 15092 - DNA, 24 bp, Homo sapiens
gaccgacagagaatgaacaaatta

SEQ ID NO: 15093 - DNA, 24 bp, Homo sapiens
ggaccgacagagaatgaacaaatt

SEQ ID NO: 15094 - DNA, 24 bp, Homo sapiens
ggaccgacagagaatgaacaaatt

SEQ ID NO: 15095 - DNA, 23 bp, Homo sapiens
cgaacccttctggtcaggcacct

SEQ ID NO: 15096 - DNA, 25 bp, Homo sapiens
actgctgaggagaaagaggacttgc

SEQ ID NO: 15097 - DNA, 23 bp, Homo sapiens
ctcagtctgtgcgggtcctgtca

SEQ ID NO: 15098 - DNA, 24 bp, Homo sapiens
gcttctccaaggaaaatggcagct

SEQ ID NO: 15099 - DNA, 24 bp, Homo sapiens
tgcttctccaaggaaaatggcagc

SEQ ID NO: 15100 - DNA, 24 bp, Homo sapiens
ttgcttctccaaggaaaatggcag

SEQ ID NO: 15101 - DNA, 24 bp, Homo sapiens
gaccgacagagaatgaacaaatta

SEQ ID NO: 15102 - DNA, 24 bp, Homo sapiens
ggaccgacagagaatgaacaaatt

SEQ ID NO: 15103 - DNA, 24 bp, Homo sapiens
aggaccgacagagaatgaacaaat

SEQ ID NO: 15104 - DNA, 23 bp, Homo sapiens
aaggcattgacaagactccatca

SEQ ID NO: 15105 - DNA, 23 bp, Homo sapiens
ctcagtctgtgcgggtcctgtca

SEQ ID NO: 15106 - DNA, 25 bp, Homo sapiens
actgctgaggagaaagaggacttgc

SEQ ID NO: 15107 - DNA, 25 bp, Homo sapiens
acatccagtgctgttaccttcagat

SEQ ID NO: 15108 - DNA, 25 bp, Homo sapiens
ggaactagcaaatcttcagcccaaa

SEQ ID NO: 15109 - DNA, 24 bp, Homo sapiens
aagcactgatgatgaggaccgaca

SEQ ID NO: 15110 - DNA, 23 bp, Homo sapiens
ctgaatcgctgtcgtgcttgcca

SEQ ID NO: 15111 - DNA, 24 bp, Homo sapiens
caggaaggtggctctcaggcatct

SEQ ID NO: 15112 - DNA, 24 bp, Homo sapiens
cacacctaactactcctctggcga

SEQ ID NO: 15113 - DNA, 23 bp, Homo sapiens
ccacaagcaatccaggaacgact

SEQ ID NO: 15114 - DNA, 25 bp, Homo sapiens
ccaacaacatcctggtcaacagcca

SEQ ID NO: 15115 - DNA, 23 bp, Homo sapiens
gttgccaacctgtcctccactgc

SEQ ID NO: 15116 - DNA, 23 bp, Homo sapiens
gcaccaccagtcttcacctccac

SEQ ID NO: 15117 - DNA, 23 bp, Homo sapiens
gttgccaacctgtcctccactgc

SEQ ID NO: 15118 - DNA, 23 bp, Homo sapiens
ccacaagcaatccaggaacgact

SEQ ID NO: 15119 - DNA, 24 bp, Homo sapiens
acccgcctcagccttccaaagtgc

SEQ ID NO: 15120 - DNA, 24 bp, Homo sapiens
cacccgcctcagccttccaaagtg

SEQ ID NO: 15121 - DNA, 24 bp, Homo sapiens
tcacccgcctcagccttccaaagt

SEQ ID NO: 15122 - DNA, 25 bp, Homo sapiens
ttcttagcacgcagtgaggaatctt

SEQ ID NO: 15123 - DNA, 25 bp, Homo sapiens
ccagggcaacaaagtcaagaggtca

SEQ ID NO: 15124 - DNA, 23 bp, Homo sapiens
agcaccccatcctgttgttccca

SEQ ID NO: 15125 - DNA, 25 bp, Homo sapiens
cctggatgttcttgccgatgcttct

SEQ ID NO: 15126 - DNA, 23 bp, Homo sapiens
cgtgacatcaagaggaagcggaa

SEQ ID NO: 15127 - DNA, 23 bp, Homo sapiens
gagccaaccacaccagcatcaca

SEQ ID NO: 15128 - DNA, 24 bp, Homo sapiens
cttgaacagcctgactcctgcctg

SEQ ID NO: 15129 - DNA, 24 bp, Homo sapiens
tggaagtggaagagcctgaagtct

SEQ ID NO: 15130 - DNA, 24 bp, Homo sapiens
acctgactcattccagcactacag

SEQ ID NO: 15131 - DNA, 24 bp, Homo sapiens
atgtttcccaggcaatctgaaggc

SEQ ID NO: 15132 - DNA, 24 bp, Homo sapiens
catgtttcccaggcaatctgaagg

SEQ ID NO: 15133 - DNA, 24 bp, Homo sapiens
acatgtttcccaggcaatctgaag

SEQ ID NO: 15134 - DNA, 23 bp, Homo sapiens
aagtgaccacagtgacctctgcc

SEQ ID NO: 15135 - DNA, 23 bp, Homo sapiens
tctctccagtgtgtccagcagcc

SEQ ID NO: 15136 - DNA, 25 bp, Homo sapiens
tgtggactttctgactggagtgctc

SEQ ID NO: 15137 - DNA, 23 bp, Homo sapiens
gtcgcagtccagctcccagacgg

SEQ ID NO: 15138 - DNA, 23 bp, Homo sapiens
cctcaacagcaaaggcagcctcg

SEQ ID NO: 15139 - DNA, 23 bp, Homo sapiens
agtgaaggtggctgctgtgggag

SEQ ID NO: 15140 - DNA, 25 bp, Homo sapiens
gctccatcctcaggttctttgtcaa

SEQ ID NO: 15141 - DNA, 23 bp, Homo sapiens
acctccgactggcttggctacat

SEQ ID NO: 15142 - DNA, 24 bp, Homo sapiens
cgggcttccaggtgagagcttaga

SEQ ID NO: 15143 - DNA, 24 bp, Homo sapiens
tcgggcttccaggtgagagcttag

SEQ ID NO: 15144 - DNA, 24 bp, Homo sapiens
gtcgggcttccaggtgagagctta

SEQ ID NO: 15145 - DNA, 23 bp, Homo sapiens
ggcaccaggcgaggctcaaggct

SEQ ID NO: 15146 - DNA, 24 bp, Homo sapiens
ttgttgggaaagggctttcgaggg

SEQ ID NO: 15147 - DNA, 25 bp, Homo sapiens
ttcaagcaattctcctcagtctcct

SEQ ID NO: 15148 - DNA, 23 bp, Homo sapiens
ggagtctcgctctgtgacccagg

SEQ ID NO: 15149 - DNA, 23 bp, Homo sapiens
tcagctcactgcaacctccacct

SEQ ID NO: 15150 - DNA, 24 bp, Homo sapiens
gaaagggacaagcgaatgcgagag

SEQ ID NO: 15151 - DNA, 24 bp, Homo sapiens
agaaagggacaagcgaatgcgaga

SEQ ID NO: 15152 - DNA, 24 bp, Homo sapiens
cagaaagggacaagcgaatgcgag

SEQ ID NO: 15153 - DNA, 23 bp, Homo sapiens
gcagaagcaggacagcaaggagg

SEQ ID NO: 15154 - DNA, 24 bp, Homo sapiens
gttccagcccagagcctgtgaaag

SEQ ID NO: 15155 - DNA, 23 bp, Homo sapiens
cacaggagcctcagtggagtctc

SEQ ID NO: 15156 - DNA, 24 bp, Homo sapiens
cgtccctgcagtcctgcccctgtg

SEQ ID NO: 15157 - DNA, 24 bp, Homo sapiens
acgtccctgcagtcctgcccctgt

SEQ ID NO: 15158 - DNA, 24 bp, Homo sapiens
tacgtccctgcagtcctgcccctg

SEQ ID NO: 15159 - DNA, 24 bp, Homo sapiens
gtgctctccagcagaagtagaaag

SEQ ID NO: 15160 - DNA, 24 bp, Homo sapiens
cgtgctctccagcagaagtagaaa

SEQ ID NO: 15161 - DNA, 24 bp, Homo sapiens
acgtgctctccagcagaagtagaa

SEQ ID NO: 15162 - DNA, 24 bp, Homo sapiens
cccaagaattgaaaaccagacaaa

SEQ ID NO: 15163 - DNA, 24 bp, Homo sapiens
ccccaagaattgaaaaccagacaa

SEQ ID NO: 15164 - DNA, 24 bp, Homo sapiens
accccaagaattgaaaaccagaca

SEQ ID NO: 15165 - DNA, 25 bp, Homo sapiens
ttctggtgattgtgccgctgatgat

SEQ ID NO: 15166 - DNA, 25 bp, Homo sapiens
acttctgttgatctggcttctggag

SEQ ID NO: 15167 - DNA, 24 bp, Homo sapiens
cctctggtgatgccactgctgatg

SEQ ID NO: 15168 - DNA, 24 bp, Homo sapiens
ttccacctctggtgatcccacctc

SEQ ID NO: 15169 - DNA, 24 bp, Homo sapiens
attccacctctggtgatcccacct

SEQ ID NO: 15170 - DNA, 24 bp, Homo sapiens
gattccacctctggtgatcccacc

SEQ ID NO: 15171 - DNA, 23 bp, Homo sapiens
agtgatgctgcctctggtgatgc

SEQ ID NO: 15172 - DNA, 24 bp, Homo sapiens
cctctggtgatgccactgctgatg

SEQ ID NO: 15173 - DNA, 25 bp, Homo sapiens
ttctggtgattgtgccgctgatgat

SEQ ID NO: 15174 - DNA, 24 bp, Homo sapiens
ggtgatgcaacctctggtgatgcc

SEQ ID NO: 15175 - DNA, 24 bp, Homo sapiens
tggtgatgcaacctctggtgatgc

SEQ ID NO: 15176 - DNA, 24 bp, Homo sapiens
ctggtgatgcaacctctggtgatg

SEQ ID NO: 15177 - DNA, 24 bp, Homo sapiens
cctctggtgatgccactgctgatg

SEQ ID NO: 15178 - DNA, 25 bp, Homo sapiens
tagtgatcccatcccaggtgaaccg

SEQ ID NO: 15179 - DNA, 25 bp, Homo sapiens
ttctggtgattgtgccgctgatgat

SEQ ID NO: 15180 - DNA, 25 bp, Homo sapiens
ctcctctagtgatgctgcctctggt

SEQ ID NO: 15181 - DNA, 25 bp, Homo sapiens
agttgatttgtgctctgagtgttgt

SEQ ID NO: 15182 - DNA, 25 bp, Homo sapiens
aactttatttatggcctgtattagt

SEQ ID NO: 15183 - DNA, 25 bp, Homo sapiens
tggcagaattgaaaacacgagtgga

SEQ ID NO: 15184 - DNA, 25 bp, Homo sapiens
tgaatgtaacaagaggcataaaaca

SEQ ID NO: 15185 - DNA, 23 bp, Homo sapiens
tgtgcgctgcagtgtgctgtatt

SEQ ID NO: 15186 - DNA, 23 bp, Homo sapiens
gaagaacccgcagcagctcccag

SEQ ID NO: 15187 - DNA, 23 bp, Homo sapiens
ctcatcccgctcggcctcctgtg

SEQ ID NO: 15188 - DNA, 23 bp, Homo sapiens
cagtggctgctgctgctgcgggg

SEQ ID NO: 15189 - DNA, 24 bp, Homo sapiens
gacctcaagtgatccgcccgcctc

SEQ ID NO: 15190 - DNA, 24 bp, Homo sapiens
ccatggtgaccaggctggtcttga

SEQ ID NO: 15191 - DNA, 24 bp, Homo sapiens
tcgtggcagtattgtggacactga

SEQ ID NO: 15192 - DNA, 24 bp, Homo sapiens
ggtgctgcctccgttccatcaatg

SEQ ID NO: 15193 - DNA, 24 bp, Homo sapiens
gaagcctgagcagcccactccaag

SEQ ID NO: 15194 - DNA, 24 bp, Homo sapiens
tgatggtgatgatgatgacgactt

SEQ ID NO: 15195 - DNA, 24 bp, Homo sapiens
aagccgtagcatcgccagaagcca

SEQ ID NO: 15196 - DNA, 24 bp, Homo sapiens
tgatggtgatgatgatgacgactt

SEQ ID NO: 15197 - DNA, 24 bp, Homo sapiens
ggtgctgcctccgttccatcaatg

SEQ ID NO: 15198 - DNA, 24 bp, Homo sapiens
tgaagaagatgatagggatgagga

SEQ ID NO: 15199 - DNA, 24 bp, Homo sapiens
atgaagaagatgatagggatgagg

SEQ ID NO: 15200 - DNA, 24 bp, Homo sapiens
gatgaagaagatgatagggatgag

SEQ ID NO: 15201 - DNA, 24 bp, Homo sapiens
taccaaatcagaatcagtcgcaaa

SEQ ID NO: 15202 - DNA, 24 bp, Homo sapiens
ctaccaaatcagaatcagtcgcaa

SEQ ID NO: 15203 - DNA, 24 bp, Homo sapiens
actaccaaatcagaatcagtcgca

SEQ ID NO: 15204 - DNA, 24 bp, Homo sapiens
agccatcactccttggagcatctc

SEQ ID NO: 15205 - DNA, 25 bp, Homo sapiens
gccttaccacacaaactccagcaaa

SEQ ID NO: 15206 - DNA, 25 bp, Homo sapiens
ttatacacagcaaactgcattggca

SEQ ID NO: 15207 - DNA, 25 bp, Homo sapiens
caagccttagcctgtctactcctca

SEQ ID NO: 15208 - DNA, 24 bp, Homo sapiens
agcacaaataactgtatcatatcc

SEQ ID NO: 15209 - DNA, 25 bp, Homo sapiens
caacaccaaggtccagtcaacagca

SEQ ID NO: 15210 - DNA, 24 bp, Homo sapiens
aggtgacagagtattggttgaagc

SEQ ID NO: 15211 - DNA, 25 bp, Homo sapiens
agccattactgaagactcctcctgc

SEQ ID NO: 15212 - DNA, 24 bp, Homo sapiens
tcagccaacagcacaaataactgt

SEQ ID NO: 15213 - DNA, 24 bp, Homo sapiens
ctcagccaacagcacaaataactg

SEQ ID NO: 15214 - DNA, 24 bp, Homo sapiens
cctcagccaacagcacaaataact

SEQ ID NO: 15215 - DNA, 24 bp, Homo sapiens
aggtgacagagtattggttgaagc

SEQ ID NO: 15216 - DNA, 25 bp, Homo sapiens
gccttttaaatggaatgcacagaga

SEQ ID NO: 15217 - DNA, 25 bp, Homo sapiens
ccattactgaagactcctcctgctg

SEQ ID NO: 15218 - DNA, 24 bp, Homo sapiens
gcagactcaaccacagcccttatt

SEQ ID NO: 15219 - DNA, 24 bp, Homo sapiens
gcaggcacagatttcagcagcttc

SEQ ID NO: 15220 - DNA, 24 bp, Homo sapiens
gcagactcaaccacagcccttatt

SEQ ID NO: 15221 - DNA, 25 bp, Homo sapiens
agccattactgaagactcctcctgc

SEQ ID NO: 15222 - DNA, 24 bp, Homo sapiens
aggtgacagagtattggttgaagc

SEQ ID NO: 15223 - DNA, 25 bp, Homo sapiens
aacccaaacggagaaaatcaggcga

SEQ ID NO: 15224 - DNA, 25 bp, Homo sapiens
atgaccctatggaagcagaagaagc

SEQ ID NO: 15225 - DNA, 25 bp, Homo sapiens
gggatgaggaagaaatgaccaaacg

SEQ ID NO: 15226 - DNA, 24 bp, Homo sapiens
atgaccctatggaagcagaagaag

SEQ ID NO: 15227 - DNA, 25 bp, Homo sapiens
aagatgatgatgaaactgaagaaga

SEQ ID NO: 15228 - DNA, 24 bp, Homo sapiens
ctcacctctaggcacagaccccac

SEQ ID NO: 15229 - DNA, 24 bp, Homo sapiens
cctcacctctaggcacagacccca

SEQ ID NO: 15230 - DNA, 24 bp, Homo sapiens
tcctcacctctaggcacagacccc

SEQ ID NO: 15231 - DNA, 25 bp, Homo sapiens
atcatccactccaacaccaacagcc

SEQ ID NO: 15232 - DNA, 25 bp, Homo sapiens
cctccaccacttcttcgtccaacac

SEQ ID NO: 15233 - DNA, 23 bp, Homo sapiens
agcctcctccactccagcagcag

SEQ ID NO: 15234 - DNA, 24 bp, Homo sapiens
atgcatatagggacaaacagcata

SEQ ID NO: 15235 - DNA, 24 bp, Homo sapiens
gatgcatatagggacaaacagcat

SEQ ID NO: 15236 - DNA, 24 bp, Homo sapiens
tgatgcatatagggacaaacagca

SEQ ID NO: 15237 - DNA, 24 bp, Homo sapiens
cttctcttcagggtgtacaggaga

SEQ ID NO: 15238 - DNA, 24 bp, Homo sapiens
tcttctcttcagggtgtacaggag

SEQ ID NO: 15239 - DNA, 24 bp, Homo sapiens
ttcttctcttcagggtgtacagga

SEQ ID NO: 15240 - DNA, 25 bp, Homo sapiens
gctaccctagagtccctgttggtgg

SEQ ID NO: 15241 - DNA, 25 bp, Homo sapiens
agggacaaacagcatattctatggc

SEQ ID NO: 15242 - DNA, 24 bp, Homo sapiens
ggtcaagtcttctcccgtagccca

SEQ ID NO: 15243 - DNA, 24 bp, Homo sapiens
cttcaagatggcgtcatagtcacc

SEQ ID NO: 15244 - DNA, 25 bp, Homo sapiens
ccagcctcctcagttctctacctat

SEQ ID NO: 15245 - DNA, 24 bp, Homo sapiens
gccagtgaatcaacagcatctcct

SEQ ID NO: 15246 - DNA, 24 bp, Homo sapiens
atctccaggcgttccaaggacagt

SEQ ID NO: 15247 - DNA, 24 bp, Homo sapiens
agcaacagcagcaacttctccagg

SEQ ID NO: 15248 - DNA, 24 bp, Homo sapiens
gccagtgaatcaacagcatctcct

SEQ ID NO: 15249 - DNA, 24 bp, Homo sapiens
ggaggctgaggcagtagaatcact

SEQ ID NO: 15250 - DNA, 24 bp, Homo sapiens
tggaatacctcctgaaggctctgc

SEQ ID NO: 15251 - DNA, 24 bp, Homo sapiens
agtgagctgagatcgtgccattgc

SEQ ID NO: 15252 - DNA, 24 bp, Homo sapiens
ccttctcaatcttggaacagcacc

SEQ ID NO: 15253 - DNA, 24 bp, Homo sapiens
tcaatcccaccagtcttccctccc

SEQ ID NO: 15254 - DNA, 25 bp, Homo sapiens
cctcttggtctcatctggtcacagc

SEQ ID NO: 15255 - DNA, 24 bp, Homo sapiens
agtatgagaggaatcagatgggtg

SEQ ID NO: 15256 - DNA, 24 bp, Homo sapiens
gagtatgagaggaatcagatgggt

SEQ ID NO: 15257 - DNA, 24 bp, Homo sapiens
tgagtatgagaggaatcagatggg

SEQ ID NO: 15258 - DNA, 24 bp, Homo sapiens
cacaggataagtctgctccatctg

SEQ ID NO: 15259 - DNA, 24 bp, Homo sapiens
tcacaggataagtctgctccatct

SEQ ID NO: 15260 - DNA, 24 bp, Homo sapiens
gtcacaggataagtctgctccatc

SEQ ID NO: 15261 - DNA, 25 bp, Homo sapiens
caagaatgactgtcaccgcatagca

SEQ ID NO: 15262 - DNA, 24 bp, Homo sapiens
tggtagaagaggagacacggcgat

SEQ ID NO: 15263 - DNA, 25 bp, Homo sapiens
tgagcagagccaaggatgagtatga

SEQ ID NO: 15264 - DNA, 25 bp, Homo sapiens
tgagcagagccaaggatgagtatga

SEQ ID NO: 15265 - DNA, 24 bp, Homo sapiens
caatctgggaagcaccgagactct

SEQ ID NO: 15266 - DNA, 25 bp, Homo sapiens
catctggacacaagcatctgacggt

SEQ ID NO: 15267 - DNA, 25 bp, Homo sapiens
catctggacacaagcatctgacggt

SEQ ID NO: 15268 - DNA, 23 bp, Homo sapiens
ggagaggttgccaggagatgcct

SEQ ID NO: 15269 - DNA, 23 bp, Homo sapiens
gtcccttctgctgcccaccattc

SEQ ID NO: 15270 - DNA, 24 bp, Homo sapiens
tctccactcctgaaccagccagtc

SEQ ID NO: 15271 - DNA, 25 bp, Homo sapiens
ctaagccatgccagtctgattgcca

SEQ ID NO: 15272 - DNA, 23 bp, Homo sapiens
gtcccttctgctgcccaccattc

SEQ ID NO: 15273 - DNA, 24 bp, Homo sapiens
caatctgggaagcaccgagactct

SEQ ID NO: 15274 - DNA, 25 bp, Homo sapiens
ggtgactcaaatatctccagccctg

SEQ ID NO: 15275 - DNA, 25 bp, Homo sapiens
tgagcagagccaaggatgagtatga

SEQ ID NO: 15276 - DNA, 24 bp, Homo sapiens
ctggcctgagcttcgcccaaagtc

SEQ ID NO: 15277 - DNA, 24 bp, Homo sapiens
cctggcctgagcttcgcccaaagt

SEQ ID NO: 15278 - DNA, 24 bp, Homo sapiens
tcctggcctgagcttcgcccaaag

SEQ ID NO: 15279 - DNA, 24 bp, Homo sapiens
tccccctttagcgcattggatatt

SEQ ID NO: 15280 - DNA, 24 bp, Homo sapiens
gtccccctttagcgcattggatat

SEQ ID NO: 15281 - DNA, 24 bp, Homo sapiens
tgtccccctttagcgcattggata

SEQ ID NO: 15282 - DNA, 24 bp, Homo sapiens
gtatggatgtggagaatcctgatt

SEQ ID NO: 15283 - DNA, 24 bp, Homo sapiens
agtatggatgtggagaatcctgat

SEQ ID NO: 15284 - DNA, 24 bp, Homo sapiens
cagtatggatgtggagaatcctga

SEQ ID NO: 15285 - DNA, 24 bp, Homo sapiens
tgcagagcgaggtgaccaaactga

SEQ ID NO: 15286 - DNA, 24 bp, Homo sapiens
ttgcagagcgaggtgaccaaactg

SEQ ID NO: 15287 - DNA, 24 bp, Homo sapiens
attgcagagcgaggtgaccaaact

SEQ ID NO: 15288 - DNA, 24 bp, Homo sapiens
aatccagaatgccccatccaggaa

SEQ ID NO: 15289 - DNA, 24 bp, Homo sapiens
aaatccagaatgccccatccagga

SEQ ID NO: 15290 - DNA, 24 bp, Homo sapiens
aaaatccagaatgccccatccagg

SEQ ID NO: 15291 - DNA, 24 bp, Homo sapiens
tgagccacacagtaagagcatctc

SEQ ID NO: 15292 - DNA, 24 bp, Homo sapiens
ttgagccacacagtaagagcatct

SEQ ID NO: 15293 - DNA, 24 bp, Homo sapiens
attgagccacacagtaagagcatc

SEQ ID NO: 15294 - DNA, 24 bp, Homo sapiens
aacaagggcagccagtgatggtgt

SEQ ID NO: 15295 - DNA, 24 bp, Homo sapiens
aaacaagggcagccagtgatggtg

SEQ ID NO: 15296 - DNA, 24 bp, Homo sapiens
gaaacaagggcagccagtgatggt

SEQ ID NO: 15297 - DNA, 24 bp, Homo sapiens
ggcctgcaataacgtacaaacctc

SEQ ID NO: 15298 - DNA, 24 bp, Homo sapiens
tggcctgcaataacgtacaaacct

SEQ ID NO: 15299 - DNA, 24 bp, Homo sapiens
gtggcctgcaataacgtacaaacc

SEQ ID NO: 15300 - DNA, 24 bp, Homo sapiens
actgtgaggagattccagcactga

SEQ ID NO: 15301 - DNA, 24 bp, Homo sapiens
aactgtgaggagattccagcactg

SEQ ID NO: 15302 - DNA, 24 bp, Homo sapiens
caactgtgaggagattccagcact

SEQ ID NO: 15303 - DNA, 24 bp, Homo sapiens
cttgctctgaggcctctcccagta

SEQ ID NO: 15304 - DNA, 24 bp, Homo sapiens
tcttgctctgaggcctctcccagt

SEQ ID NO: 15305 - DNA, 24 bp, Homo sapiens
atcttgctctgaggcctctcccag

SEQ ID NO: 15306 - DNA, 23 bp, Homo sapiens
aaccgactcttggtgcagtgctc

SEQ ID NO: 15307 - DNA, 23 bp, Homo sapiens
ccctcagtgttggagccagcagc

SEQ ID NO: 15308 - DNA, 23 bp, Homo sapiens
ggaagcagcctccaagccagccg

SEQ ID NO: 15309 - DNA, 24 bp, Homo sapiens
ctccagcagaatccctcagtgttg

SEQ ID NO: 15310 - DNA, 24 bp, Homo sapiens
gtccagccagcacatctcctctaa

SEQ ID NO: 15311 - DNA, 25 bp, Homo sapiens
aaccagcgggaatgtcaacaaggaa

SEQ ID NO: 15312 - DNA, 25 bp, Homo sapiens
aacactgcttctggcttactcagga

SEQ ID NO: 15313 - DNA, 25 bp, Homo sapiens
gctccacatcaggttcataacttat

SEQ ID NO: 15314 - DNA, 25 bp, Homo sapiens
tcaagagtatggagttcaaggctgg

SEQ ID NO: 15315 - DNA, 25 bp, Homo sapiens
tcttacggataatcagattgtcagt

SEQ ID NO: 15316 - DNA, 24 bp, Homo sapiens
ctttgattgtgaagcatttagatg

SEQ ID NO: 15317 - DNA, 25 bp, Homo sapiens
catctactcagtggttttcagcaac

SEQ ID NO: 15318 - DNA, 24 bp, Homo sapiens
ggaaacccagcatcaaaaactctt

SEQ ID NO: 15319 - DNA, 24 bp, Homo sapiens
gttcagaagtaaaaatttatagct

SEQ ID NO: 15320 - DNA, 23 bp, Homo sapiens
gagctgtaaaacgcaagtcttct

SEQ ID NO: 15321 - DNA, 24 bp, Homo sapiens
aatggaaccctggtttccaaacaa

SEQ ID NO: 15322 - DNA, 25 bp, Homo sapiens
acgcaagtcttctgagaataatgga

SEQ ID NO: 15323 - DNA, 25 bp, Homo sapiens
actgtgaggagattccagcactgaa

SEQ ID NO: 15324 - DNA, 25 bp, Homo sapiens
gcttggacccatctactcagtggtt

SEQ ID NO: 15325 - DNA, 23 bp, Homo sapiens
tgcgacaccaccatcttcaacct

SEQ ID NO: 15326 - DNA, 23 bp, Homo sapiens
ggtgtgtcctcggtgtgggtttg

SEQ ID NO: 15327 - DNA, 24 bp, Homo sapiens
gtgtggactgctaccggatgaaga

SEQ ID NO: 15328 - DNA, 25 bp, Homo sapiens
accagagaacttaatgcccacacag

SEQ ID NO: 15329 - DNA, 24 bp, Homo sapiens
ctccagcagaatccctcagtgttg

SEQ ID NO: 15330 - DNA, 24 bp, Homo sapiens
gtccagccagcacatctcctctaa

SEQ ID NO: 15331 - DNA, 24 bp, Homo sapiens
gtccagccagcacatctcctctaa

SEQ ID NO: 15332 - DNA, 23 bp, Homo sapiens
ccctcagtgttggagccagcagc

SEQ ID NO: 15333 - DNA, 23 bp, Homo sapiens
ggaagcagcctccaagccagccg

SEQ ID NO: 15334 - DNA, 25 bp, Homo sapiens
accagagaacttaatgcccacacag

SEQ ID NO: 15335 - DNA, 25 bp, Homo sapiens
agagaaagaattgccaacagggtgc

SEQ ID NO: 15336 - DNA, 25 bp, Homo sapiens
cggtgtgggtttggagtatgtgtgg

SEQ ID NO: 15337 - DNA, 24 bp, Homo sapiens
gcctcaaggactaaccatcaagcc

SEQ ID NO: 15338 - DNA, 25 bp, Homo sapiens
tgtgataatcgcttgctgtgcttgc

SEQ ID NO: 15339 - DNA, 25 bp, Homo sapiens
tttagggagtgctggaaacaagggc

SEQ ID NO: 15340 - DNA, 25 bp, Homo sapiens
caggaaagagtttggtgagcaggaa

SEQ ID NO: 15341 - DNA, 25 bp, Homo sapiens
tcatcacaggagccacagtaggaga

SEQ ID NO: 15342 - DNA, 23 bp, Homo sapiens
ccgagtacacaaggcgagatggc

SEQ ID NO: 15343 - DNA, 25 bp, Homo sapiens
acaggagccacagtaggagacttct

SEQ ID NO: 15344 - DNA, 25 bp, Homo sapiens
caggaaagagtttggtgagcaggaa

SEQ ID NO: 15345 - DNA, 25 bp, Homo sapiens
tgaactctgaactttggaaacctga

SEQ ID NO: 15346 - DNA, 25 bp, Homo sapiens
tcatcacaggagccacagtaggaga

SEQ ID NO: 15347 - DNA, 25 bp, Homo sapiens
caggaaagagtttggtgagcaggaa

SEQ ID NO: 15348 - DNA, 25 bp, Homo sapiens
tttagggagtgctggaaacaagggc

SEQ ID NO: 15349 - DNA, 24 bp, Homo sapiens
ctcagagcctgtcatccgtccttg

SEQ ID NO: 15350 - DNA, 24 bp, Homo sapiens
cctcagagcctgtcatccgtcctt

SEQ ID NO: 15351 - DNA, 24 bp, Homo sapiens
tcctcagagcctgtcatccgtcct

SEQ ID NO: 15352 - DNA, 24 bp, Homo sapiens
aagttaagcagcttatggaagtga

SEQ ID NO: 15353 - DNA, 24 bp, Homo sapiens
aaagttaagcagcttatggaagtg

SEQ ID NO: 15354 - DNA, 24 bp, Homo sapiens
taaagttaagcagcttatggaagt

SEQ ID NO: 15355 - DNA, 24 bp, Homo sapiens
tggttcagcagatgtcacaggatt

SEQ ID NO: 15356 - DNA, 25 bp, Homo sapiens
gggctctggaatttgggtcagaacc

SEQ ID NO: 15357 - DNA, 25 bp, Homo sapiens
aaatagtaatcagattcccatcagc

SEQ ID NO: 15358 - DNA, 24 bp, Homo sapiens
cacatcaaacttgctaagcggcgg

SEQ ID NO: 15359 - DNA, 24 bp, Homo sapiens
atctctgtgtctgtccaccagcca

SEQ ID NO: 15360 - DNA, 25 bp, Homo sapiens
cgagaatcaacacctggagacagtc

SEQ ID NO: 15361 - DNA, 25 bp, Homo sapiens
acacagcagaatagtacaagtcacc

SEQ ID NO: 15362 - DNA, 24 bp, Homo sapiens
cagttgaaagctccgagtttgggc

SEQ ID NO: 15363 - DNA, 23 bp, Homo sapiens
ggcaaacatcaccagctcccaga

SEQ ID NO: 15364 - DNA, 24 bp, Homo sapiens
acaacttccgtcattacctcctgc

SEQ ID NO: 15365 - DNA, 25 bp, Homo sapiens
agtccagtagcaatgtcttcctctt

SEQ ID NO: 15366 - DNA, 23 bp, Homo sapiens
agcacactggcgacctgactagc

SEQ ID NO: 15367 - DNA, 25 bp, Homo sapiens
gacctctgcctcctggattcaagtg

SEQ ID NO: 15368 - DNA, 23 bp, Homo sapiens
caacctcagcctcccgagtagct

SEQ ID NO: 15369 - DNA, 23 bp, Homo sapiens
atagcagtgcaccaccatgtatg

SEQ ID NO: 15370 - DNA, 24 bp, Homo sapiens
gcaatggcacaatctcggctcact

SEQ ID NO: 15371 - DNA, 24 bp, Homo sapiens
caattctcctgcctcagcctcctg

SEQ ID NO: 15372 - DNA, 24 bp, Homo sapiens
ggattacaggcacctgccaccatg

SEQ ID NO: 15373 - DNA, 24 bp, Homo sapiens
ggtccaaaaagttcccattctgtg

SEQ ID NO: 15374 - DNA, 24 bp, Homo sapiens
aggtccaaaaagttcccattctgt

SEQ ID NO: 15375 - DNA, 24 bp, Homo sapiens
gaggtccaaaaagttcccattctg

SEQ ID NO: 15376 - DNA, 24 bp, Homo sapiens
cagcgtacgagcccactccatgct

SEQ ID NO: 15377 - DNA, 24 bp, Homo sapiens
ccagcgtacgagcccactccatgc

SEQ ID NO: 15378 - DNA, 24 bp, Homo sapiens
tccagcgtacgagcccactccatg

SEQ ID NO: 15379 - DNA, 25 bp, Homo sapiens
ttgtcttgttgaaacatcgtggtgc

SEQ ID NO: 15380 - DNA, 24 bp, Homo sapiens
gcctgtgggttattttggtcttgt

SEQ ID NO: 15381 - DNA, 25 bp, Homo sapiens
tgacctggaaactaaataggatgtg

SEQ ID NO: 15382 - DNA, 24 bp, Homo sapiens
caaagggccagcacgcttcctggg

SEQ ID NO: 15383 - DNA, 24 bp, Homo sapiens
ccaaagggccagcacgcttcctgg

SEQ ID NO: 15384 - DNA, 24 bp, Homo sapiens
gccaaagggccagcacgcttcctg

SEQ ID NO: 15385 - DNA, 24 bp, Homo sapiens
gtcctccgcagagtgagcctcgca

SEQ ID NO: 15386 - DNA, 24 bp, Homo sapiens
tgtcctccgcagagtgagcctcgc

SEQ ID NO: 15387 - DNA, 24 bp, Homo sapiens
ctgtcctccgcagagtgagcctcg

SEQ ID NO: 15388 - DNA, 25 bp, Homo sapiens
ggcggagaacatgatccagacctac

SEQ ID NO: 15389 - DNA, 23 bp, Homo sapiens
gctgaaggagggtgctgagaacc

SEQ ID NO: 15390 - DNA, 23 bp, Homo sapiens
ccagcgacgccgtgcagagtgag

SEQ ID NO: 15391 - DNA, 24 bp, Homo sapiens
atgcttgtcaggtgagtgtgcttt

SEQ ID NO: 15392 - DNA, 24 bp, Homo sapiens
catgcttgtcaggtgagtgtgctt

SEQ ID NO: 15393 - DNA, 24 bp, Homo sapiens
acatgcttgtcaggtgagtgtgct

SEQ ID NO: 15394 - DNA, 23 bp, Homo sapiens
ccagatgaagaccttagccaccg

SEQ ID NO: 15395 - DNA, 25 bp, Homo sapiens
caccagcagctccagttcataccaa

SEQ ID NO: 15396 - DNA, 23 bp, Homo sapiens
gctataaccgcctgaccgtgctg

SEQ ID NO: 15397 - DNA, 25 bp, Homo sapiens
aaacatttccctgagccagtaaaca

SEQ ID NO: 15398 - DNA, 25 bp, Homo sapiens
agaaacctgacttctaagtgtgggt

SEQ ID NO: 15399 - DNA, 25 bp, Homo sapiens
gcactgattttgtgagtttgaccca

SEQ ID NO: 15400 - DNA, 24 bp, Homo sapiens
gaagtagacagcctgatgtgtgaa

SEQ ID NO: 15401 - DNA, 24 bp, Homo sapiens
tgaagtagacagcctgatgtgtga

SEQ ID NO: 15402 - DNA, 24 bp, Homo sapiens
atgaagtagacagcctgatgtgtg

SEQ ID NO: 15403 - DNA, 24 bp, Homo sapiens
ccctggacggtcaaaagcaacatc

SEQ ID NO: 15404 - DNA, 24 bp, Homo sapiens
ggagtccaagtgaaaccagatcat

SEQ ID NO: 15405 - DNA, 24 bp, Homo sapiens
gcagaacgagtaaaagtaaaagcg

SEQ ID NO: 15406 - DNA, 25 bp, Homo sapiens
agccaacctctgataaaccctccca

SEQ ID NO: 15407 - DNA, 25 bp, Homo sapiens
gcacaggacacttcactaaatcggc

SEQ ID NO: 15408 - DNA, 25 bp, Homo sapiens
cggaagaaattaactgacagccctg

SEQ ID NO: 15409 - DNA, 23 bp, Homo sapiens
gccaggaggatgatgctctaccc

SEQ ID NO: 15410 - DNA, 23 bp, Homo sapiens
gccagtcaagagcaagcagccaa

SEQ ID NO: 15411 - DNA, 24 bp, Homo sapiens
tgaggaacgacggcataaccaacg

SEQ ID NO: 15412 - DNA, 23 bp, Homo sapiens
gctggcagtctagttctactcag

SEQ ID NO: 15413 - DNA, 23 bp, Homo sapiens
tcagcaacaggcagccaggagct

SEQ ID NO: 15414 - DNA, 23 bp, Homo sapiens
cttgagaaattctttctttggaa

SEQ ID NO: 15415 - DNA, 24 bp, Homo sapiens
tgtggtcttgatggacgatgatgt

SEQ ID NO: 15416 - DNA, 24 bp, Homo sapiens
ggagcatccgtttctgacgcacat

SEQ ID NO: 15417 - DNA, 24 bp, Homo sapiens
cacgatggtagagaagagagttct

SEQ ID NO: 15418 - DNA, 24 bp, Homo sapiens
aggtgatccacccgcctcagcctc

SEQ ID NO: 15419 - DNA, 24 bp, Homo sapiens
caggtgatccacccgcctcagcct

SEQ ID NO: 15420 - DNA, 24 bp, Homo sapiens
tcaggtgatccacccgcctcagcc

SEQ ID NO: 15421 - DNA, 24 bp, Homo sapiens
aagcgattctcccgcctcagcctc

SEQ ID NO: 15422 - DNA, 24 bp, Homo sapiens
caagcgattctcccgcctcagcct

SEQ ID NO: 15423 - DNA, 24 bp, Homo sapiens
tcaagcgattctcccgcctcagcc

SEQ ID NO: 15424 - DNA, 24 bp, Homo sapiens
gacatctcatgggtttgtggatgc

SEQ ID NO: 15425 - DNA, 24 bp, Homo sapiens
agacatctcatgggtttgtggatg

SEQ ID NO: 15426 - DNA, 24 bp, Homo sapiens
cagacatctcatgggtttgtggat

SEQ ID NO: 15427 - DNA, 24 bp, Homo sapiens
gaagttcaatggactgcctcaact

SEQ ID NO: 15428 - DNA, 24 bp, Homo sapiens
agaagttcaatggactgcctcaac

SEQ ID NO: 15429 - DNA, 24 bp, Homo sapiens
cagaagttcaatggactgcctcaa

SEQ ID NO: 15430 - DNA, 24 bp, Homo sapiens
tctcttcatagcctggttcacctg

SEQ ID NO: 15431 - DNA, 24 bp, Homo sapiens
ttctcttcatagcctggttcacct

SEQ ID NO: 15432 - DNA, 24 bp, Homo sapiens
tttctcttcatagcctggttcacc

SEQ ID NO: 15433 - DNA, 24 bp, Homo sapiens
agccctgtggtagttgagaaatcc

SEQ ID NO: 15434 - DNA, 24 bp, Homo sapiens
accagcagctcacatcattcacac

SEQ ID NO: 15435 - DNA, 24 bp, Homo sapiens
ttcagaaccagaatccgtagaagc

SEQ ID NO: 15436 - DNA, 24 bp, Homo sapiens
accagcagctcacatcattcacac

SEQ ID NO: 15437 - DNA, 23 bp, Homo sapiens
attatggtgctcgtcctcctccg

SEQ ID NO: 15438 - DNA, 25 bp, Homo sapiens
tggatgggagacaaagatcaaagca

SEQ ID NO: 15439 - DNA, 25 bp, Homo sapiens
tcgatatgaagaagcaaataacaac

SEQ ID NO: 15440 - DNA, 23 bp, Homo sapiens
agtgagggtgttcagagggaggc

SEQ ID NO: 15441 - DNA, 25 bp, Homo sapiens
tccgatttgaataccaacaatttgc

SEQ ID NO: 15442 - DNA, 25 bp, Homo sapiens
aatagctctgagattaggcaatgga

SEQ ID NO: 15443 - DNA, 23 bp, Homo sapiens
agtgagggtgttcagagggaggc

SEQ ID NO: 15444 - DNA, 25 bp, Homo sapiens
ccgtatgctacaccaactcacaccg

SEQ ID NO: 15445 - DNA, 25 bp, Homo sapiens
ttactcagaaacctccacacctact

SEQ ID NO: 15446 - DNA, 23 bp, Homo sapiens
tttgccacgcctccacggataaa

SEQ ID NO: 15447 - DNA, 25 bp, Homo sapiens
ggattgataggcagcatattcctga

SEQ ID NO: 15448 - DNA, 25 bp, Homo sapiens
ggttcagctccagagattgatcctt

SEQ ID NO: 15449 - DNA, 23 bp, Homo sapiens
agtgagggtgttcagagggaggc

SEQ ID NO: 15450 - DNA, 25 bp, Homo sapiens
tcttcaaacctcctgtagagagcca

SEQ ID NO: 15451 - DNA, 25 bp, Homo sapiens
tcttcaaacctcctgtagagagcca

SEQ ID NO: 15452 - DNA, 23 bp, Homo sapiens
agtgagggtgttcagagggaggc

SEQ ID NO: 15453 - DNA, 25 bp, Homo sapiens
tggatgggagacaaagatcaaagca

SEQ ID NO: 15454 - DNA, 25 bp, Homo sapiens
aaggaatacaagcaggagatggacc

SEQ ID NO: 15455 - DNA, 23 bp, Homo sapiens
actccgactgatccacgctgaca

SEQ ID NO: 15456 - DNA, 25 bp, Homo sapiens
gctgctagagtctacaaggaggctg

SEQ ID NO: 15457 - DNA, 25 bp, Homo sapiens
ggctccctgacttgtgtgaagaaga

SEQ ID NO: 15458 - DNA, 25 bp, Homo sapiens
ctgctagagtctacaaggaggctgc

SEQ ID NO: 15459 - DNA, 23 bp, Homo sapiens
actccgactgatccacgctgaca

SEQ ID NO: 15460 - DNA, 24 bp, Homo sapiens
cgcggtgctggcattacagacatc

SEQ ID NO: 15461 - DNA, 24 bp, Homo sapiens
ccgcggtgctggcattacagacat

SEQ ID NO: 15462 - DNA, 24 bp, Homo sapiens
cccgcggtgctggcattacagaca

SEQ ID NO: 15463 - DNA, 24 bp, Homo sapiens
acagtattgaatttcgtgaatgta

SEQ ID NO: 15464 - DNA, 24 bp, Homo sapiens
aacagtattgaatttcgtgaatgt

SEQ ID NO: 15465 - DNA, 24 bp, Homo sapiens
caacagtattgaatttcgtgaatg

SEQ ID NO: 15466 - DNA, 24 bp, Homo sapiens
catggaagaagatccccagacttc

SEQ ID NO: 15467 - DNA, 24 bp, Homo sapiens
ccatggaagaagatccccagactt

SEQ ID NO: 15468 - DNA, 24 bp, Homo sapiens
tccatggaagaagatccccagact

SEQ ID NO: 15469 - DNA, 24 bp, Homo sapiens
gaatgcatcagttattgattctgc

SEQ ID NO: 15470 - DNA, 24 bp, Homo sapiens
agaatgcatcagttattgattctg

SEQ ID NO: 15471 - DNA, 24 bp, Homo sapiens
gagaatgcatcagttattgattct

SEQ ID NO: 15472 - DNA, 24 bp, Homo sapiens
actaatttcagacttttggaaaag

SEQ ID NO: 15473 - DNA, 24 bp, Homo sapiens
tactaatttcagacttttggaaaa

SEQ ID NO: 15474 - DNA, 24 bp, Homo sapiens
ttactaatttcagacttttggaaa

SEQ ID NO: 15475 - DNA, 24 bp, Homo sapiens
ttgatgagcgggtgacagtcatgg

SEQ ID NO: 15476 - DNA, 24 bp, Homo sapiens
tttgatgagcgggtgacagtcatg

SEQ ID NO: 15477 - DNA, 24 bp, Homo sapiens
gtttgatgagcgggtgacagtcat

SEQ ID NO: 15478 - DNA, 24 bp, Homo sapiens
ttcagagactatgtggctgtggca

SEQ ID NO: 15479 - DNA, 24 bp, Homo sapiens
ttcgtgcccaagaaccagagagtg

SEQ ID NO: 15480 - DNA, 24 bp, Homo sapiens
ctcaagtgaagtgcctgatggacc

SEQ ID NO: 15481 - DNA, 24 bp, Homo sapiens
tgacatcagcagtaagagagccca

SEQ ID NO: 15482 - DNA, 24 bp, Homo sapiens
ctgttctggcaggatgtctgaagg

SEQ ID NO: 15483 - DNA, 24 bp, Homo sapiens
aaacctgttccgcgcttttctggg

SEQ ID NO: 15484 - DNA, 24 bp, Homo sapiens
gcacctgccttctggacaactacg

SEQ ID NO: 15485 - DNA, 24 bp, Homo sapiens
gcactttcagccctggaatccttt

SEQ ID NO: 15486 - DNA, 24 bp, Homo sapiens
gcaagcagatgttcctcacccaga

SEQ ID NO: 15487 - DNA, 24 bp, Homo sapiens
tgacatcagcagtaagagagccca

SEQ ID NO: 15488 - DNA, 24 bp, Homo sapiens
ctgttctggcaggatgtctgaagg

SEQ ID NO: 15489 - DNA, 24 bp, Homo sapiens
ctgaagagatatgctgtgccctca

SEQ ID NO: 15490 - DNA, 24 bp, Homo sapiens
agagctgctaaatgtaaaattcca

SEQ ID NO: 15491 - DNA, 24 bp, Homo sapiens
gaagatcgcaccttactctgttga

SEQ ID NO: 15492 - DNA, 24 bp, Homo sapiens
ttccagagatttcggtttgcttgt

SEQ ID NO: 15493 - DNA, 24 bp, Homo sapiens
gcggtgctggcattacagacatct

SEQ ID NO: 15494 - DNA, 24 bp, Homo sapiens
ctgttctggcaggatgtctgaagg

SEQ ID NO: 15495 - DNA, 24 bp, Homo sapiens
ctgaagagatatgctgtgccctca

SEQ ID NO: 15496 - DNA, 24 bp, Homo sapiens
gcacctgccttctggacaactacg

SEQ ID NO: 15497 - DNA, 24 bp, Homo sapiens
tgtcctcacttctgtgcaacttca

SEQ ID NO: 15498 - DNA, 24 bp, Homo sapiens
agcccaaactacctgttctggcag

SEQ ID NO: 15499 - DNA, 24 bp, Homo sapiens
gcacctgccttctggacaactacg

SEQ ID NO: 15500 - DNA, 24 bp, Homo sapiens
aagtcttgttaaagtggtgtgccc

SEQ ID NO: 15501 - DNA, 24 bp, Homo sapiens
gcactttcagccctggaatccttt

SEQ ID NO: 15502 - DNA, 24 bp, Homo sapiens
gcacctgccttctggacaactacg

SEQ ID NO: 15503 - DNA, 24 bp, Homo sapiens
aagtcttgttaaagtggtgtgccc

SEQ ID NO: 15504 - DNA, 24 bp, Homo sapiens
tgtagaattgaaaaaagctgcact

SEQ ID NO: 15505 - DNA, 24 bp, Homo sapiens
aagtcttgttaaagtggtgtgccc

SEQ ID NO: 15506 - DNA, 24 bp, Homo sapiens
gcacctgccttctggacaactacg

SEQ ID NO: 15507 - DNA, 24 bp, Homo sapiens
tgacatcagcagtaagagagccca

SEQ ID NO: 15508 - DNA, 24 bp, Homo sapiens
gcactttcagccctggaatccttt

SEQ ID NO: 15509 - DNA, 24 bp, Homo sapiens
aagtcttgttaaagtggtgtgccc

SEQ ID NO: 15510 - DNA, 24 bp, Homo sapiens
tgacatcagcagtaagagagccca

SEQ ID NO: 15511 - DNA, 24 bp, Homo sapiens
ttagagcctacgttcctgcactgc

SEQ ID NO: 15512 - DNA, 24 bp, Homo sapiens
tttggcaaagaggtggcagttaaa

SEQ ID NO: 15513 - DNA, 24 bp, Homo sapiens
ggttgcccctcatcagtggtttct

SEQ ID NO: 15514 - DNA, 24 bp, Homo sapiens
cgtgatgtattctcgccttcccaa

SEQ ID NO: 15515 - DNA, 24 bp, Homo sapiens
gccattgatgtgttgaagtccagg

SEQ ID NO: 15516 - DNA, 24 bp, Homo sapiens
gcctaagtttcacacgccagtcct

SEQ ID NO: 15517 - DNA, 24 bp, Homo sapiens
tgtgtgcttgaacaaagtgaccaa

SEQ ID NO: 15518 - DNA, 24 bp, Homo sapiens
tgctgtgttctttctgctgccaaa

SEQ ID NO: 15519 - DNA, 24 bp, Homo sapiens
aacactctgtctggaggtggtact

SEQ ID NO: 15520 - DNA, 24 bp, Homo sapiens
gtgacaggatggaagtgcaagagc

SEQ ID NO: 15521 - DNA, 24 bp, Homo sapiens
agtatgaatgtggatcaagatgga

SEQ ID NO: 15522 - DNA, 24 bp, Homo sapiens
ggagaagcttacccctcttccaga

SEQ ID NO: 15523 - DNA, 24 bp, Homo sapiens
gattgatgcttacatgacgctggc

SEQ ID NO: 15524 - DNA, 24 bp, Homo sapiens
caggcgtatccagcacttgtggtg

SEQ ID NO: 15525 - DNA, 24 bp, Homo sapiens
gatctcttccgttccctgctggca

SEQ ID NO: 15526 - DNA, 24 bp, Homo sapiens
caggcgtatccagcacttgtggtg

SEQ ID NO: 15527 - DNA, 24 bp, Homo sapiens
cggtatccagaggagactttgagc

SEQ ID NO: 15528 - DNA, 24 bp, Homo sapiens
gatctcttccgttccctgctggca

SEQ ID NO: 15529 - DNA, 24 bp, Homo sapiens
caggcgtatccagcacttgtggtg

SEQ ID NO: 15530 - DNA, 24 bp, Homo sapiens
tagaacggtatccagaggagactt

SEQ ID NO: 15531 - DNA, 24 bp, Homo sapiens
gaagccagattgaagtttcctaga

SEQ ID NO: 15532 - DNA, 24 bp, Homo sapiens
actggacaaagaccaagccgttgc

SEQ ID NO: 15533 - DNA, 24 bp, Homo sapiens
tacccgcaggctattgtttatccc

SEQ ID NO: 15534 - DNA, 24 bp, Homo sapiens
agtaagttggatcaaggaggagtg

SEQ ID NO: 15535 - DNA, 24 bp, Homo sapiens
cccttcatcataagcagcgaaagc

SEQ ID NO: 15536 - DNA, 24 bp, Homo sapiens
tcactgataactacccgcaggcta

SEQ ID NO: 15537 - DNA, 24 bp, Homo sapiens
actggacaaagaccaagccgttgc

SEQ ID NO: 15538 - DNA, 24 bp, Homo sapiens
caggcgtatccagcacttgtggtg

SEQ ID NO: 15539 - DNA, 24 bp, Homo sapiens
gattgatgcttacatgacgctggc

SEQ ID NO: 15540 - DNA, 24 bp, Homo sapiens
taccagagagcattccagcacctc

SEQ ID NO: 15541 - DNA, 24 bp, Homo sapiens
tacccgcaggctattgtttatccc

SEQ ID NO: 15542 - DNA, 24 bp, Homo sapiens
actggacaaagaccaagccgttgc

SEQ ID NO: 15543 - DNA, 24 bp, Homo sapiens
gatctcttccgttccctgctggca

SEQ ID NO: 15544 - DNA, 24 bp, Homo sapiens
gctgaactagcaaaaacccctgta

SEQ ID NO: 15545 - DNA, 24 bp, Homo sapiens
tgggtgacccaaaggctccaggcc

SEQ ID NO: 15546 - DNA, 24 bp, Homo sapiens
ttgaaaaaatgtatgaaagaatgt

SEQ ID NO: 15547 - DNA, 24 bp, Homo sapiens
gacagcctcaggaggggaggaggc

SEQ ID NO: 15548 - DNA, 24 bp, Homo sapiens
ggacagcctcaggaggggaggagg

SEQ ID NO: 15549 - DNA, 24 bp, Homo sapiens
gggacagcctcaggaggggaggag

SEQ ID NO: 15550 - DNA, 24 bp, Homo sapiens
tgggtgtgaagacctcagaaagta

SEQ ID NO: 15551 - DNA, 24 bp, Homo sapiens
gtgggtgtgaagacctcagaaagt

SEQ ID NO: 15552 - DNA, 24 bp, Homo sapiens
tgtgggtgtgaagacctcagaaag

SEQ ID NO: 15553 - DNA, 24 bp, Homo sapiens
cctatttccaagctccctgatgga

SEQ ID NO: 15554 - DNA, 24 bp, Homo sapiens
ccctatttccaagctccctgatgg

SEQ ID NO: 15555 - DNA, 24 bp, Homo sapiens
accctatttccaagctccctgatg

SEQ ID NO: 15556 - DNA, 25 bp, Homo sapiens
ccaaagtgactgatgaagggaagga

SEQ ID NO: 15557 - DNA, 23 bp, Homo sapiens
gccagtccacatccgctctcacc

SEQ ID NO: 15558 - DNA, 25 bp, Homo sapiens
cccaccaaagccacctactcttctt

SEQ ID NO: 15559 - DNA, 24 bp, Homo sapiens
ggtgtcccgccgaaagaatgttgg

SEQ ID NO: 15560 - DNA, 25 bp, Homo sapiens
ccaaagtgactgatgaagggaagga

SEQ ID NO: 15561 - DNA, 23 bp, Homo sapiens
gccagtccacatccgctctcacc

SEQ ID NO: 15562 - DNA, 25 bp, Homo sapiens
gaggagactgtcactactcttgatt

SEQ ID NO: 15563 - DNA, 24 bp, Homo sapiens
acgaagtttgtttgtgcggttggt

SEQ ID NO: 15564 - DNA, 24 bp, Homo sapiens
ggtgtcccgccgaaagaatgttgg

SEQ ID NO: 15565 - DNA, 23 bp, Homo sapiens
gaggaacagaggaaacagcgggc

SEQ ID NO: 15566 - DNA, 25 bp, Homo sapiens
aagacaaagatgaaagggaggcacc

SEQ ID NO: 15567 - DNA, 25 bp, Homo sapiens
tgaagagaccaatgaagactcagga

SEQ ID NO: 15568 - DNA, 25 bp, Homo sapiens
aacctgaagctgagattagtcctgg

SEQ ID NO: 15569 - DNA, 25 bp, Homo sapiens
agcctctgagaacttgaagcatatt

SEQ ID NO: 15570 - DNA, 23 bp, Homo sapiens
ggcggagatgcgaccaccattaa

SEQ ID NO: 15571 - DNA, 25 bp, Homo sapiens
agcctctgagaacttgaagcatatt

SEQ ID NO: 15572 - DNA, 25 bp, Homo sapiens
tgaagagaccaatgaagactcagga

SEQ ID NO: 15573 - DNA, 25 bp, Homo sapiens
aagacaaagatgaaagggaggcacc

SEQ ID NO: 15574 - DNA, 24 bp, Homo sapiens
gagcaatacaggcagtttcagcgt

SEQ ID NO: 15575 - DNA, 24 bp, Homo sapiens
tgagcaatacaggcagtttcagcg

SEQ ID NO: 15576 - DNA, 24 bp, Homo sapiens
atgagcaatacaggcagtttcagc

SEQ ID NO: 15577 - DNA, 25 bp, Homo sapiens
ggattacctcacagacctcatcacc

SEQ ID NO: 15578 - DNA, 24 bp, Homo sapiens
tccgcacgtccaagaagatgtacc

SEQ ID NO: 15579 - DNA, 23 bp, Homo sapiens
gccagtcctcatggtcatcagcc

SEQ ID NO: 15580 - DNA, 25 bp, Homo sapiens
ggattacctcacagacctcatcacc

SEQ ID NO: 15581 - DNA, 25 bp, Homo sapiens
cttaatgaatacaacggctcctacg

SEQ ID NO: 15582 - DNA, 23 bp, Homo sapiens
gcacagcacgagagccgcacctt

SEQ ID NO: 15583 - DNA, 24 bp, Homo sapiens
gcatgaggaccatcaatgagactc

SEQ ID NO: 15584 - DNA, 24 bp, Homo sapiens
gtcctcaaccagctacacgtacag

SEQ ID NO: 15585 - DNA, 24 bp, Homo sapiens
gcaatacaggcagtttcagcgtcg

SEQ ID NO: 15586 - DNA, 24 bp, Homo sapiens
ccccaacatagagacctcattaag

SEQ ID NO: 15587 - DNA, 24 bp, Homo sapiens
tccccaacatagagacctcattaa

SEQ ID NO: 15588 - DNA, 24 bp, Homo sapiens
ttccccaacatagagacctcatta

SEQ ID NO: 15589 - DNA, 24 bp, Homo sapiens
gctcgtggttgacagaacaaggcg

SEQ ID NO: 15590 - DNA, 24 bp, Homo sapiens
atgtgaagcatcatcggtggttcc

SEQ ID NO: 15591 - DNA, 24 bp, Homo sapiens
aaactgaagcctcccatcgtgccc

SEQ ID NO: 15592 - DNA, 24 bp, Homo sapiens
accggaagcagaaaaagaagatgg

SEQ ID NO: 15593 - DNA, 24 bp, Homo sapiens
taccggaagcagaaaaagaagatg

SEQ ID NO: 15594 - DNA, 24 bp, Homo sapiens
ctaccggaagcagaaaaagaagat

SEQ ID NO: 15595 - DNA, 24 bp, Homo sapiens
tgcttcacagtcacctggaatgcc

SEQ ID NO: 15596 - DNA, 25 bp, Homo sapiens
ggctactacaagaacattcacgaca

SEQ ID NO: 15597 - DNA, 23 bp, Homo sapiens
aatccgtgctgtgtatcctgctt

SEQ ID NO: 15598 - DNA, 24 bp, Homo sapiens
agaacccacaggtgcatttcacag

SEQ ID NO: 15599 - DNA, 24 bp, Homo sapiens
aagaacccacaggtgcatttcaca

SEQ ID NO: 15600 - DNA, 24 bp, Homo sapiens
aaagaacccacaggtgcatttcac

SEQ ID NO: 15601 - DNA, 24 bp, Homo sapiens
aagaatgggagcgagagtttcagc

SEQ ID NO: 15602 - DNA, 24 bp, Homo sapiens
ttcaggagtatgagaagcagtgga

SEQ ID NO: 15603 - DNA, 24 bp, Homo sapiens
tctcagatgcctccacctctacct

SEQ ID NO: 15604 - DNA, 24 bp, Homo sapiens
ggattacctggcagtggaaagaca

SEQ ID NO: 15605 - DNA, 24 bp, Homo sapiens
tgagaggattacctggcagtggaa

SEQ ID NO: 15606 - DNA, 24 bp, Homo sapiens
gcagaagcacactcagttacagca

SEQ ID NO: 15607 - DNA, 24 bp, Homo sapiens
aagaatgggagcgagagtttcagc

SEQ ID NO: 15608 - DNA, 24 bp, Homo sapiens
ttcaggagtatgagaagcagtgga

SEQ ID NO: 15609 - DNA, 24 bp, Homo sapiens
gcagaagcacactcagttacagca

SEQ ID NO: 15610 - DNA, 24 bp, Homo sapiens
gaggacccagaagaagatgccagg

SEQ ID NO: 15611 - DNA, 24 bp, Homo sapiens
tgccaccagtcaagttccagaatc

SEQ ID NO: 15612 - DNA, 24 bp, Homo sapiens
cctggatgccatcaatgacagagt

SEQ ID NO: 15613 - DNA, 24 bp, Homo sapiens
ggaggagacttaccgcaccagcat

SEQ ID NO: 15614 - DNA, 24 bp, Homo sapiens
tgagaggattacctggcagtggaa

SEQ ID NO: 15615 - DNA, 24 bp, Homo sapiens
tgagcgttctgagcagaatcggag

SEQ ID NO: 15616 - DNA, 24 bp, Homo sapiens
ctgagcgttctgagcagaatcgga

SEQ ID NO: 15617 - DNA, 24 bp, Homo sapiens
tctgagcgttctgagcagaatcgg

SEQ ID NO: 15618 - DNA, 25 bp, Homo sapiens
aacgatgtctggaatggctggtctt

SEQ ID NO: 15619 - DNA, 24 bp, Homo sapiens
gcaaaggatgggatattccgccgt

SEQ ID NO: 15620 - DNA, 24 bp, Homo sapiens
ccgcttctttgtcaccactctccc

SEQ ID NO: 15621 - DNA, 25 bp, Homo sapiens
ggcttaatgtcaggagtctgcttgg

SEQ ID NO: 15622 - DNA, 25 bp, Homo sapiens
tgctaaggacattgtgactctccag

SEQ ID NO: 15623 - DNA, 23 bp, Homo sapiens
acagtgatggctctagaatgtct

SEQ ID NO: 15624 - DNA, 24 bp, Homo sapiens
cgaacccggagcacgacatcataa

SEQ ID NO: 15625 - DNA, 24 bp, Homo sapiens
gcgaacccggagcacgacatcata

SEQ ID NO: 15626 - DNA, 24 bp, Homo sapiens
agcgaacccggagcacgacatcat

SEQ ID NO: 15627 - DNA, 24 bp, Homo sapiens
gccagcaaagggatggaatgtggg

SEQ ID NO: 15628 - DNA, 24 bp, Homo sapiens
tgccagcaaagggatggaatgtgg

SEQ ID NO: 15629 - DNA, 24 bp, Homo sapiens
ctgccagcaaagggatggaatgtg

SEQ ID NO: 15630 - DNA, 25 bp, Homo sapiens
gctgtgatgctttgggaaactggaa

SEQ ID NO: 15631 - DNA, 23 bp, Homo sapiens
aatgctgtggctcttcttccaga

SEQ ID NO: 15632 - DNA, 23 bp, Homo sapiens
aatgctgtggctcttcttccaga

SEQ ID NO: 15633 - DNA, 25 bp, Homo sapiens
gctgtgatgctttgggaaactggaa

SEQ ID NO: 15634 - DNA, 25 bp, Homo sapiens
tccatcagaatgacaccttctcagg

SEQ ID NO: 15635 - DNA, 24 bp, Homo sapiens
atcctcccatctcagcctcccaag

SEQ ID NO: 15636 - DNA, 24 bp, Homo sapiens
actcctggactcaagtgatcctcc

SEQ ID NO: 15637 - DNA, 24 bp, Homo sapiens
tcattgcagcctcaacttcctgtg

SEQ ID NO: 15638 - DNA, 24 bp, Homo sapiens
agctgggattacaggtgtctgcaa

SEQ ID NO: 15639 - DNA, 24 bp, Homo sapiens
tagctgggattacaggtgtctgca

SEQ ID NO: 15640 - DNA, 24 bp, Homo sapiens
gtagctgggattacaggtgtctgc

SEQ ID NO: 15641 - DNA, 23 bp, Homo sapiens
gcagtggcacaatcttggctcac

SEQ ID NO: 15642 - DNA, 25 bp, Homo sapiens
ttcaagcaattctcctgcctcagcc

SEQ ID NO: 15643 - DNA, 24 bp, Homo sapiens
ttcagaaacaggcaacagcgagtg

SEQ ID NO: 15644 - DNA, 24 bp, Homo sapiens
attcagaaacaggcaacagcgagt

SEQ ID NO: 15645 - DNA, 24 bp, Homo sapiens
gattcagaaacaggcaacagcgag

SEQ ID NO: 15646 - DNA, 24 bp, Homo sapiens
gtccgcagcaggagctcccgccca

SEQ ID NO: 15647 - DNA, 24 bp, Homo sapiens
cgtccgcagcaggagctcccgccc

SEQ ID NO: 15648 - DNA, 24 bp, Homo sapiens
acgtccgcagcaggagctcccgcc

SEQ ID NO: 15649 - DNA, 23 bp, Homo sapiens
agcctttgcggtccttagacagc

SEQ ID NO: 15650 - DNA, 23 bp, Homo sapiens
acctaatctgggagcctgcaagt

SEQ ID NO: 15651 - DNA, 25 bp, Homo sapiens
gcagaaagcacagaaagggagtcac

SEQ ID NO: 15652 - DNA, 24 bp, Homo sapiens
cgggttcagtgaggaatgggaagc

SEQ ID NO: 15653 - DNA, 24 bp, Homo sapiens
tcatcgctctacacctgagtcacg

SEQ ID NO: 15654 - DNA, 24 bp, Homo sapiens
gggttcagtgaggaatgggaagcc

SEQ ID NO: 15655 - DNA, 24 bp, Homo sapiens
tcatcgctctacacctgagtcacg

SEQ ID NO: 15656 - DNA, 23 bp, Homo sapiens
gcagtatcctcgctggtgaagac

SEQ ID NO: 15657 - DNA, 24 bp, Homo sapiens
acaacagcctttgcggtccttaga

SEQ ID NO: 15658 - DNA, 24 bp, Homo sapiens
gcgggttcagtgaggaatgggaag

SEQ ID NO: 15659 - DNA, 24 bp, Homo sapiens
tcatcgctctacacctgagtcacg

SEQ ID NO: 15660 - DNA, 23 bp, Homo sapiens
gcagtatcctcgctggtgaagac

SEQ ID NO: 15661 - DNA, 24 bp, Homo sapiens
ttggtgatacaagtggctgagcag

SEQ ID NO: 15662 - DNA, 24 bp, Homo sapiens
ctgtgtgttgggaatacaagcagc

SEQ ID NO: 15663 - DNA, 24 bp, Homo sapiens
ttgtcggaaatacaagccactgag

SEQ ID NO: 15664 - DNA, 24 bp, Homo sapiens
cagagaatcagaatgacaatagag

SEQ ID NO: 15665 - DNA, 24 bp, Homo sapiens
gcagagaatcagaatgacaataga

SEQ ID NO: 15666 - DNA, 24 bp, Homo sapiens
agcagagaatcagaatgacaatag

SEQ ID NO: 15667 - DNA, 24 bp, Homo sapiens
tctccttgcaggtaggttttgtca

SEQ ID NO: 15668 - DNA, 24 bp, Homo sapiens
atctccttgcaggtaggttttgtc

SEQ ID NO: 15669 - DNA, 24 bp, Homo sapiens
catctccttgcaggtaggttttgt

SEQ ID NO: 15670 - DNA, 24 bp, Homo sapiens
atgagtatgcctgccgtgtgaacc

SEQ ID NO: 15671 - DNA, 24 bp, Homo sapiens
ttgtctttcagcaaggactggtct

SEQ ID NO: 15672 - DNA, 24 bp, Homo sapiens
agagagaattgaaaaagtggagca

SEQ ID NO: 15673 - DNA, 24 bp, Homo sapiens
cgagacatgtaagcagcatcatgg

SEQ ID NO: 15674 - DNA, 24 bp, Homo sapiens
aggagggctggcaacttagaggtg

SEQ ID NO: 15675 - DNA, 24 bp, Homo sapiens
aggcatggttgtggttaatctggt

SEQ ID NO: 15676 - DNA, 24 bp, Homo sapiens
tgagtgctgtctccatgtttgatg

SEQ ID NO: 15677 - DNA, 24 bp, Homo sapiens
ctaggagggctggcaacttagagg

SEQ ID NO: 15678 - DNA, 24 bp, Homo sapiens
tctgagcaggttgctccacaggta

SEQ ID NO: 15679 - DNA, 24 bp, Homo sapiens
cctgccgtgtgaaccatgtgactt

SEQ ID NO: 15680 - DNA, 24 bp, Homo sapiens
tcacccccactgaaaaagatgagt

SEQ ID NO: 15681 - DNA, 24 bp, Homo sapiens
aggagggctggcaacttagaggtg

SEQ ID NO: 15682 - DNA, 24 bp, Homo sapiens
taggagggctggcaacttagaggt

SEQ ID NO: 15683 - DNA, 24 bp, Homo sapiens
ctaggagggctggcaacttagagg

SEQ ID NO: 15684 - DNA, 24 bp, Homo sapiens
tggcaacttagaggtggggagcag

SEQ ID NO: 15685 - DNA, 24 bp, Homo sapiens
ctggcaacttagaggtggggagca

SEQ ID NO: 15686 - DNA, 24 bp, Homo sapiens
gctggcaacttagaggtggggagc

SEQ ID NO: 15687 - DNA, 24 bp, Homo sapiens
ttgtctttcagcaaggactggtct

SEQ ID NO: 15688 - DNA, 24 bp, Homo sapiens
agagagaattgaaaaagtggagca

SEQ ID NO: 15689 - DNA, 24 bp, Homo sapiens
catccatccgacattgaagttgac

SEQ ID NO: 15690 - DNA, 24 bp, Homo sapiens
aggagggctggcaacttagaggtg

SEQ ID NO: 15691 - DNA, 24 bp, Homo sapiens
tgtttgatgtatctgagcaggttg

SEQ ID NO: 15692 - DNA, 24 bp, Homo sapiens
gaactcttcaatctcttgcactca

SEQ ID NO: 15693 - DNA, 24 bp, Homo sapiens
tagcctgcctcgggcctccacctg

SEQ ID NO: 15694 - DNA, 24 bp, Homo sapiens
atagcctgcctcgggcctccacct

SEQ ID NO: 15695 - DNA, 24 bp, Homo sapiens
catagcctgcctcgggcctccacc

SEQ ID NO: 15696 - DNA, 24 bp, Homo sapiens
ttcctttgcagtctcgaagatatg

SEQ ID NO: 15697 - DNA, 24 bp, Homo sapiens
tttcctttgcagtctcgaagatat

SEQ ID NO: 15698 - DNA, 24 bp, Homo sapiens
ttttcctttgcagtctcgaagata

SEQ ID NO: 15699 - DNA, 24 bp, Homo sapiens
ataatagcgctgcagctgtgtcaa

SEQ ID NO: 15700 - DNA, 24 bp, Homo sapiens
aataatagcgctgcagctgtgtca

SEQ ID NO: 15701 - DNA, 24 bp, Homo sapiens
aaataatagcgctgcagctgtgtc

SEQ ID NO: 15702 - DNA, 24 bp, Homo sapiens
ggatggaaggccacatgcattgga

SEQ ID NO: 15703 - DNA, 24 bp, Homo sapiens
cctgcctcagcatcccccagtgct

SEQ ID NO: 15704 - DNA, 24 bp, Homo sapiens
ccctgcctcagcatcccccagtgc

SEQ ID NO: 15705 - DNA, 24 bp, Homo sapiens
accctgcctcagcatcccccagtg

SEQ ID NO: 15706 - DNA, 24 bp, Homo sapiens
ctggcctccagcaccctctccagg

SEQ ID NO: 15707 - DNA, 24 bp, Homo sapiens
cctggcctccagcaccctctccag

SEQ ID NO: 15708 - DNA, 24 bp, Homo sapiens
tcctggcctccagcaccctctcca

SEQ ID NO: 15709 - DNA, 25 bp, Homo sapiens
tgacttcttactcaacctgtctggc

SEQ ID NO: 15710 - DNA, 25 bp, Homo sapiens
gcacactgatttcatccctcaacac

SEQ ID NO: 15711 - DNA, 24 bp, Homo sapiens
cagttgttgctcagtcggaaggct

SEQ ID NO: 15712 - DNA, 25 bp, Homo sapiens
gcagatgagagcagcgattaaccaa

SEQ ID NO: 15713 - DNA, 25 bp, Homo sapiens
ggtgatggtggttagcaagatgaac

SEQ ID NO: 15714 - DNA, 23 bp, Homo sapiens
gtcgctgggaagggacggccctc

SEQ ID NO: 15715 - DNA, 25 bp, Homo sapiens
acctcaaatgatctacctgcctcgg

SEQ ID NO: 15716 - DNA, 23 bp, Homo sapiens
catgttggtcaggccggtctcaa

SEQ ID NO: 15717 - DNA, 23 bp, Homo sapiens
aaagtgctgggattacatcatga

SEQ ID NO: 15718 - DNA, 24 bp, Homo sapiens
ggattacaggcactcaccaccacg

SEQ ID NO: 15719 - DNA, 23 bp, Homo sapiens
gtctcactctgtcaccaaggctg

SEQ ID NO: 15720 - DNA, 25 bp, Homo sapiens
caattctcctgccttagcctcttga

SEQ ID NO: 15721 - DNA, 24 bp, Homo sapiens
aacaaagggaccagatgctgccag

SEQ ID NO: 15722 - DNA, 24 bp, Homo sapiens
aacctcctgtaccaactagagtgg

SEQ ID NO: 15723 - DNA, 24 bp, Homo sapiens
ctggaggtggcaagaaggatgaca

SEQ ID NO: 15724 - DNA, 24 bp, Homo sapiens
tggtggtcatggtcctggaggtgg

SEQ ID NO: 15725 - DNA, 24 bp, Homo sapiens
agagtggtggtcatggtcctggag

SEQ ID NO: 15726 - DNA, 24 bp, Homo sapiens
caagtggccaaggcaagatgggtc

SEQ ID NO: 15727 - DNA, 24 bp, Homo sapiens
agtggtggaggaacttccggcagc

SEQ ID NO: 15728 - DNA, 24 bp, Homo sapiens
aacctcctgtaccaactagagtgg

SEQ ID NO: 15729 - DNA, 24 bp, Homo sapiens
ctggaggtggcaagaaggatgaca

SEQ ID NO: 15730 - DNA, 24 bp, Homo sapiens
tgggtcaaagtcagagtggtggtc

SEQ ID NO: 15731 - DNA, 24 bp, Homo sapiens
gtgtggaggcgggcatgatcgcac

SEQ ID NO: 15732 - DNA, 24 bp, Homo sapiens
tgtgtggaggcgggcatgatcgca

SEQ ID NO: 15733 - DNA, 24 bp, Homo sapiens
gtgtgtggaggcgggcatgatcgc

SEQ ID NO: 15734 - DNA, 23 bp, Homo sapiens
agcgattcccctgcctcagtctc

SEQ ID NO: 15735 - DNA, 23 bp, Homo sapiens
ctcgctgcagtctccacctccag

SEQ ID NO: 15736 - DNA, 23 bp, Homo sapiens
caggctggagtgcagtggcacaa

SEQ ID NO: 15737 - DNA, 23 bp, Homo sapiens
gccgtccaggtcaaacagcacat

SEQ ID NO: 15738 - DNA, 25 bp, Homo sapiens
cctctgcttggactggttctgactc

SEQ ID NO: 15739 - DNA, 25 bp, Homo sapiens
ttggtgacgatgatgctggtgaagg

SEQ ID NO: 15740 - DNA, 25 bp, Homo sapiens
gcccagggagatgacatggtttgtg

SEQ ID NO: 15741 - DNA, 23 bp, Homo sapiens
cggaggctggggagatgacatca

SEQ ID NO: 15742 - DNA, 25 bp, Homo sapiens
ctgaaccgtcgtcctgagattgtgg

SEQ ID NO: 15743 - DNA, 23 bp, Homo sapiens
gccgtccaggtcaaacagcacat

SEQ ID NO: 15744 - DNA, 25 bp, Homo sapiens
cctctgcttggactggttctgactc

SEQ ID NO: 15745 - DNA, 24 bp, Homo sapiens
aaatggaagtggatgaggcagaga

SEQ ID NO: 15746 - DNA, 24 bp, Homo sapiens
aaaatggaagtggatgaggcagag

SEQ ID NO: 15747 - DNA, 24 bp, Homo sapiens
gaaaatggaagtggatgaggcaga

SEQ ID NO: 15748 - DNA, 24 bp, Homo sapiens
tttcatttcagtgactcgatggaa

SEQ ID NO: 15749 - DNA, 24 bp, Homo sapiens
ttttcatttcagtgactcgatgga

SEQ ID NO: 15750 - DNA, 24 bp, Homo sapiens
cttttcatttcagtgactcgatgg

SEQ ID NO: 15751 - DNA, 24 bp, Homo sapiens
ccctattgcttctgtgcctggatc

SEQ ID NO: 15752 - DNA, 24 bp, Homo sapiens
ggaagacaacctcctgatggcata

SEQ ID NO: 15753 - DNA, 24 bp, Homo sapiens
tcttagatgatcctcaggctgtga

SEQ ID NO: 15754 - DNA, 24 bp, Homo sapiens
taacccagcccgagttatgcctgc

SEQ ID NO: 15755 - DNA, 24 bp, Homo sapiens
aagaacctgagccaaacttccagt

SEQ ID NO: 15756 - DNA, 24 bp, Homo sapiens
aatggaagtggatgaggcagagaa

SEQ ID NO: 15757 - DNA, 25 bp, Homo sapiens
tgaggcagaagaccatgttgagagc

SEQ ID NO: 15758 - DNA, 25 bp, Homo sapiens
tccagagcacataagcaacatcatc

SEQ ID NO: 15759 - DNA, 25 bp, Homo sapiens
gagcctctggtgttgacatagaaga

SEQ ID NO: 15760 - DNA, 23 bp, Homo sapiens
aagccatcagaaccagcatgagg

SEQ ID NO: 15761 - DNA, 25 bp, Homo sapiens
atcaccatcctcactacctataccg

SEQ ID NO: 15762 - DNA, 25 bp, Homo sapiens
actgatgcctgccaagacatttgct

SEQ ID NO: 15763 - DNA, 24 bp, Homo sapiens
gctgtttgacggtgagtctgcacc

SEQ ID NO: 15764 - DNA, 24 bp, Homo sapiens
ggctgtttgacggtgagtctgcac

SEQ ID NO: 15765 - DNA, 24 bp, Homo sapiens
gggctgtttgacggtgagtctgca

SEQ ID NO: 15766 - DNA, 24 bp, Homo sapiens
tgcccaaagtgctgggattacagg

SEQ ID NO: 15767 - DNA, 24 bp, Homo sapiens
ctgcccaaagtgctgggattacag

SEQ ID NO: 15768 - DNA, 24 bp, Homo sapiens
gctgcccaaagtgctgggattaca

SEQ ID NO: 15769 - DNA, 24 bp, Homo sapiens
agactcgtactgtgagtagtttac

SEQ ID NO: 15770 - DNA, 24 bp, Homo sapiens
cagactcgtactgtgagtagttta

SEQ ID NO: 15771 - DNA, 24 bp, Homo sapiens
gcagactcgtactgtgagtagttt

SEQ ID NO: 15772 - DNA, 24 bp, Homo sapiens
aggaaggtgaaaatattagaataa

SEQ ID NO: 15773 - DNA, 24 bp, Homo sapiens
gaggaaggtgaaaatattagaata

SEQ ID NO: 15774 - DNA, 24 bp, Homo sapiens
agaggaaggtgaaaatattagaat

SEQ ID NO: 15775 - DNA, 24 bp, Homo sapiens
tgctgaaggtcaagaagacaagtg

SEQ ID NO: 15776 - DNA, 24 bp, Homo sapiens
gttgctggacttggatgggaggtg

SEQ ID NO: 15777 - DNA, 24 bp, Homo sapiens
atgctacctcaactgtggaagtga

SEQ ID NO: 15778 - DNA, 24 bp, Homo sapiens
aatcactccactcctaccagccat

SEQ ID NO: 15779 - DNA, 24 bp, Homo sapiens
agattgctgaggaccaaacctgct

SEQ ID NO: 15780 - DNA, 24 bp, Homo sapiens
gcttggagtggaagaataaggaga

SEQ ID NO: 15781 - DNA, 24 bp, Homo sapiens
cagcctcctgagtaagtgggacca

SEQ ID NO: 15782 - DNA, 24 bp, Homo sapiens
tcagcctcctgagtaagtgggacc

SEQ ID NO: 15783 - DNA, 24 bp, Homo sapiens
ctcagcctcctgagtaagtgggac

SEQ ID NO: 15784 - DNA, 24 bp, Homo sapiens
tagcaatccaggagaaggtgctgg

SEQ ID NO: 15785 - DNA, 24 bp, Homo sapiens
gtagcaatccaggagaaggtgctg

SEQ ID NO: 15786 - DNA, 24 bp, Homo sapiens
ggtagcaatccaggagaaggtgct

SEQ ID NO: 15787 - DNA, 24 bp, Homo sapiens
ctacaactaataaaaccgaaaaaa

SEQ ID NO: 15788 - DNA, 24 bp, Homo sapiens
gctacaactaataaaaccgaaaaa

SEQ ID NO: 15789 - DNA, 24 bp, Homo sapiens
ggctacaactaataaaaccgaaaa

SEQ ID NO: 15790 - DNA, 25 bp, Homo sapiens
atcgttacatcaccaagggaaatct

SEQ ID NO: 15791 - DNA, 25 bp, Homo sapiens
gcacttctggataatggaactcggt

SEQ ID NO: 15792 - DNA, 25 bp, Homo sapiens
cgtagtaacagatttcgcagagatg

SEQ ID NO: 15793 - DNA, 24 bp, Homo sapiens
cgtcgtgatccagaagtccagagc

SEQ ID NO: 15794 - DNA, 24 bp, Homo sapiens
ggatgtgttcaaggcaagaccgaa

SEQ ID NO: 15795 - DNA, 24 bp, Homo sapiens
acatccagttctccaaccacaagg

SEQ ID NO: 15796 - DNA, 23 bp, Homo sapiens
caggcggtgaactcggtccagtc

SEQ ID NO: 15797 - DNA, 25 bp, Homo sapiens
ttctccaagttcggcacagtgttga

SEQ ID NO: 15798 - DNA, 25 bp, Homo sapiens
cgtgctcaggatcatcgtggagaac

SEQ ID NO: 15799 - DNA, 23 bp, Homo sapiens
caggcggtgaactcggtccagtc

SEQ ID NO: 15800 - DNA, 24 bp, Homo sapiens
acatccagttctccaaccacaagg

SEQ ID NO: 15801 - DNA, 24 bp, Homo sapiens
aagcagttctcctgcctcagcctc

SEQ ID NO: 15802 - DNA, 24 bp, Homo sapiens
caagcagttctcctgcctcagcct

SEQ ID NO: 15803 - DNA, 24 bp, Homo sapiens
tcaagcagttctcctgcctcagcc

SEQ ID NO: 15804 - DNA, 24 bp, Homo sapiens
aagcaattctcctgcctcagccac

SEQ ID NO: 15805 - DNA, 24 bp, Homo sapiens
caagcaattctcctgcctcagcca

SEQ ID NO: 15806 - DNA, 24 bp, Homo sapiens
tcaagcaattctcctgcctcagcc

SEQ ID NO: 15807 - DNA, 24 bp, Homo sapiens
aagcagttctcctgcctcagccac

SEQ ID NO: 15808 - DNA, 24 bp, Homo sapiens
caagcagttctcctgcctcagcca

SEQ ID NO: 15809 - DNA, 24 bp, Homo sapiens
tcaagcagttctcctgcctcagcc

SEQ ID NO: 15810 - DNA, 25 bp, Homo sapiens
agtacctgtgcagtgtcctcatcca

SEQ ID NO: 15811 - DNA, 23 bp, Homo sapiens
cctgctgctgccagacaaccacc

SEQ ID NO: 15812 - DNA, 25 bp, Homo sapiens
ggtcatcggctatccctactactcc

SEQ ID NO: 15813 - DNA, 24 bp, Homo sapiens
gctgccatgccatcaactcgtatg

SEQ ID NO: 15814 - DNA, 23 bp, Homo sapiens
cgaggtcgtctccacactgaagc

SEQ ID NO: 15815 - DNA, 24 bp, Homo sapiens
gtatgccatcgccaccaaggacaa

SEQ ID NO: 15816 - DNA, 24 bp, Homo sapiens
tggcccggcagccccccaaggaag

SEQ ID NO: 15817 - DNA, 24 bp, Homo sapiens
ctggcccggcagccccccaaggaa

SEQ ID NO: 15818 - DNA, 24 bp, Homo sapiens
gctggcccggcagccccccaagga

SEQ ID NO: 15819 - DNA, 24 bp, Homo sapiens
tggcccggcaggtggagcccccga

SEQ ID NO: 15820 - DNA, 24 bp, Homo sapiens
ctggcccggcaggtggagcccccg

SEQ ID NO: 15821 - DNA, 24 bp, Homo sapiens
gctggcccggcaggtggagccccc

SEQ ID NO: 15822 - DNA, 25 bp, Homo sapiens
gctaccaataccacccttccacaca

SEQ ID NO: 15823 - DNA, 23 bp, Homo sapiens
gtacgcaccacaacacccaacat

SEQ ID NO: 15824 - DNA, 23 bp, Homo sapiens
tattgcaccaaacccagcccagc

SEQ ID NO: 15825 - DNA, 24 bp, Homo sapiens
gggaggctgaggcaggagaatcac

SEQ ID NO: 15826 - DNA, 24 bp, Homo sapiens
tgggaggctgaggcaggagaatca

SEQ ID NO: 15827 - DNA, 24 bp, Homo sapiens
ttgggaggctgaggcaggagaatc

SEQ ID NO: 15828 - DNA, 25 bp, Homo sapiens
ggctgacctcaaactcctgacctca

SEQ ID NO: 15829 - DNA, 23 bp, Homo sapiens
cgcaccaccatgcctggctaatt

SEQ ID NO: 15830 - DNA, 23 bp, Homo sapiens
ccagggtgctgggattacaggtg

SEQ ID NO: 15831 - DNA, 24 bp, Homo sapiens
cctgcctcagcctcttcaagcttt

SEQ ID NO: 15832 - DNA, 24 bp, Homo sapiens
tcctgcctcagcctcttcaagctt

SEQ ID NO: 15833 - DNA, 24 bp, Homo sapiens
ctcctgcctcagcctcttcaagct

SEQ ID NO: 15834 - DNA, 24 bp, Homo sapiens
cacctccacaggtcccaccacatc

SEQ ID NO: 15835 - DNA, 24 bp, Homo sapiens
ccacctccacaggtcccaccacat

SEQ ID NO: 15836 - DNA, 24 bp, Homo sapiens
gccacctccacaggtcccaccaca

SEQ ID NO: 15837 - DNA, 25 bp, Homo sapiens
agtcaagcctgaggaactggagagt

SEQ ID NO: 15838 - DNA, 25 bp, Homo sapiens
aggaggaatgttggacagtgacaca

SEQ ID NO: 15839 - DNA, 24 bp, Homo sapiens
acctgtgcctgtccctcctattcc

SEQ ID NO: 15840 - DNA, 24 bp, Homo sapiens
aagaactggaggccacagctgctg

SEQ ID NO: 15841 - DNA, 24 bp, Homo sapiens
caagaactggaggccacagctgct

SEQ ID NO: 15842 - DNA, 24 bp, Homo sapiens
ccaagaactggaggccacagctgc

SEQ ID NO: 15843 - DNA, 25 bp, Homo sapiens
cgcagaactcggaaacatggtatca

SEQ ID NO: 15844 - DNA, 23 bp, Homo sapiens
aattccttcagacattgccaagc

SEQ ID NO: 15845 - DNA, 25 bp, Homo sapiens
tgaggaagcagcaaatggaaagaaa

SEQ ID NO: 15846 - DNA, 24 bp, Homo sapiens
cagatgtggaagaagatccctcct

SEQ ID NO: 15847 - DNA, 24 bp, Homo sapiens
acagatgtggaagaagatccctcc

SEQ ID NO: 15848 - DNA, 24 bp, Homo sapiens
cacagatgtggaagaagatccctc

SEQ ID NO: 15849 - DNA, 23 bp, Homo sapiens
ccaccgtcacttcctgctgagag

SEQ ID NO: 15850 - DNA, 23 bp, Homo sapiens
ccatgcctgtccaggagacccag

SEQ ID NO: 15851 - DNA, 23 bp, Homo sapiens
cccacacctgctgcggcccacag

SEQ ID NO: 15852 - DNA, 24 bp, Homo sapiens
aggctgcaatggttcagtttgatc

SEQ ID NO: 15853 - DNA, 24 bp, Homo sapiens
aaggctgcaatggttcagtttgat

SEQ ID NO: 15854 - DNA, 24 bp, Homo sapiens
gaaggctgcaatggttcagtttga

SEQ ID NO: 15855 - DNA, 24 bp, Homo sapiens
tggcgagctggataccatgtttgt

SEQ ID NO: 15856 - DNA, 24 bp, Homo sapiens
atggcgagctggataccatgtttg

SEQ ID NO: 15857 - DNA, 24 bp, Homo sapiens
catggcgagctggataccatgttt

SEQ ID NO: 15858 - DNA, 24 bp, Homo sapiens
caaaaatccaagtatgccctttaa

SEQ ID NO: 15859 - DNA, 24 bp, Homo sapiens
ccaaaaatccaagtatgcccttta

SEQ ID NO: 15860 - DNA, 24 bp, Homo sapiens
gccaaaaatccaagtatgcccttt

SEQ ID NO: 15861 - DNA, 25 bp, Homo sapiens
tgtatgtttggacactcgtggcacc

SEQ ID NO: 15862 - DNA, 25 bp, Homo sapiens
tgactgagtgagacttctagcatga

SEQ ID NO: 15863 - DNA, 25 bp, Homo sapiens
tgcttcccatgtaacttctccagtg

SEQ ID NO: 15864 - DNA, 24 bp, Homo sapiens
cttgcccccaggacgcccgaacgc

SEQ ID NO: 15865 - DNA, 24 bp, Homo sapiens
tcttgcccccaggacgcccgaacg

SEQ ID NO: 15866 - DNA, 24 bp, Homo sapiens
ctcttgcccccaggacgcccgaac

SEQ ID NO: 15867 - DNA, 24 bp, Homo sapiens
atttctgccaggtgcgccatttat

SEQ ID NO: 15868 - DNA, 24 bp, Homo sapiens
aatttctgccaggtgcgccattta

SEQ ID NO: 15869 - DNA, 24 bp, Homo sapiens
aaatttctgccaggtgcgccattt

SEQ ID NO: 15870 - DNA, 23 bp, Homo sapiens
cgattctcctgcctcagcctcct

SEQ ID NO: 15871 - DNA, 23 bp, Homo sapiens
ttactgcaacctccacctcctga

SEQ ID NO: 15872 - DNA, 24 bp, Homo sapiens
cgctggctgaggtggctggcctgc

SEQ ID NO: 15873 - DNA, 24 bp, Homo sapiens
tcgctggctgaggtggctggcctg

SEQ ID NO: 15874 - DNA, 24 bp, Homo sapiens
ctcgctggctgaggtggctggcct

SEQ ID NO: 15875 - DNA, 24 bp, Homo sapiens
gatggggtctggagatgagctgcc

SEQ ID NO: 15876 - DNA, 24 bp, Homo sapiens
agatggggtctggagatgagctgc

SEQ ID NO: 15877 - DNA, 24 bp, Homo sapiens
gagatggggtctggagatgagctg

SEQ ID NO: 15878 - DNA, 24 bp, Homo sapiens
atccatccattcacccactcagcc

SEQ ID NO: 15879 - DNA, 24 bp, Homo sapiens
agcgcctgctggtggctggcctgc

SEQ ID NO: 15880 - DNA, 24 bp, Homo sapiens
aagcgcctgctggtggctggcctg

SEQ ID NO: 15881 - DNA, 24 bp, Homo sapiens
caagcgcctgctggtggctggcct

SEQ ID NO: 15882 - DNA, 25 bp, Homo sapiens
atccagattagcatccaggaggacc

SEQ ID NO: 15883 - DNA, 25 bp, Homo sapiens
gactccatcaatgctctcctcaagg

SEQ ID NO: 15884 - DNA, 24 bp, Homo sapiens
gtcctgtcctacaccagcgtgaga

SEQ ID NO: 15885 - DNA, 25 bp, Homo sapiens
atccagattagcatccaggaggacc

SEQ ID NO: 15886 - DNA, 25 bp, Homo sapiens
gactccatcaatgctctcctcaagg

SEQ ID NO: 15887 - DNA, 23 bp, Homo sapiens
tcctacttgggcagcgacgagat

SEQ ID NO: 15888 - DNA, 24 bp, Homo sapiens
agccatcattgtgggccaggtgaa

SEQ ID NO: 15889 - DNA, 24 bp, Homo sapiens
aagccatcattgtgggccaggtga

SEQ ID NO: 15890 - DNA, 24 bp, Homo sapiens
gaagccatcattgtgggccaggtg

SEQ ID NO: 15891 - DNA, 24 bp, Homo sapiens
cccccacccaggttgtgtctcaac

SEQ ID NO: 15892 - DNA, 24 bp, Homo sapiens
tcccccacccaggttgtgtctcaa

SEQ ID NO: 15893 - DNA, 24 bp, Homo sapiens
atcccccacccaggttgtgtctca

SEQ ID NO: 15894 - DNA, 25 bp, Homo sapiens
ttggacacaaggaggttggagttaa

SEQ ID NO: 15895 - DNA, 24 bp, Homo sapiens
cctgaaggaagtaagcaagcatga

SEQ ID NO: 15896 - DNA, 24 bp, Homo sapiens
tgattgcctttcacctccactttg

SEQ ID NO: 15897 - DNA, 23 bp, Homo sapiens
cgagtcagcgaaccactgctcag

SEQ ID NO: 15898 - DNA, 23 bp, Homo sapiens
ttgtgtctcaacttccgatgggc

SEQ ID NO: 15899 - DNA, 25 bp, Homo sapiens
cagcctcaccaatggaaccactatc

SEQ ID NO: 15900 - DNA, 24 bp, Homo sapiens
aatgatccatccacctcagcctcc

SEQ ID NO: 15901 - DNA, 24 bp, Homo sapiens
ttgcccacgctggtctcgaattcc

SEQ ID NO: 15902 - DNA, 23 bp, Homo sapiens
cgtagcacctgcccaaccaaact

SEQ ID NO: 15903 - DNA, 25 bp, Homo sapiens
gttaagatcctggttccatgccgca

SEQ ID NO: 15904 - DNA, 23 bp, Homo sapiens
cgcaaggactcggctgatgatgg

SEQ ID NO: 15905 - DNA, 23 bp, Homo sapiens
cacggagcgactgtctctgaggt

SEQ ID NO: 15906 - DNA, 25 bp, Homo sapiens
tctcaatgccaccatccagtgcttg

SEQ ID NO: 15907 - DNA, 25 bp, Homo sapiens
acaccacctctagccaactacctgc

SEQ ID NO: 15908 - DNA, 24 bp, Homo sapiens
ctcttcggcaaccagtgaaagcat

SEQ ID NO: 15909 - DNA, 24 bp, Homo sapiens
tccgttcccctgcagcaccatctc

SEQ ID NO: 15910 - DNA, 24 bp, Homo sapiens
atctcctttggctcttcggcaacc

SEQ ID NO: 15911 - DNA, 24 bp, Homo sapiens
ctctggttctcctggtagccaaga

SEQ ID NO: 15912 - DNA, 24 bp, Homo sapiens
gctcacacaaaccacctcctcacc

SEQ ID NO: 15913 - DNA, 24 bp, Homo sapiens
ccaagtcctgatgttgagtgtgct

SEQ ID NO: 15914 - DNA, 24 bp, Homo sapiens
gaggaggaggagagctggctgtat

SEQ ID NO: 15915 - DNA, 24 bp, Homo sapiens
ggcggcttgctggacgaggtggag

SEQ ID NO: 15916 - DNA, 24 bp, Homo sapiens
cgccattttagagtcccagaacct

SEQ ID NO: 15917 - DNA, 24 bp, Homo sapiens
gcgccattttagagtcccagaacc

SEQ ID NO: 15918 - DNA, 24 bp, Homo sapiens
agcgccattttagagtcccagaac

SEQ ID NO: 15919 - DNA, 24 bp, Homo sapiens
gtgctgcagaacatggtttcatct

SEQ ID NO: 15920 - DNA, 24 bp, Homo sapiens
agtgctgcagaacatggtttcatc

SEQ ID NO: 15921 - DNA, 24 bp, Homo sapiens
cagtgctgcagaacatggtttcat

SEQ ID NO: 15922 - DNA, 24 bp, Homo sapiens
ctcggctcaaggcgtcaacatgaa

SEQ ID NO: 15923 - DNA, 25 bp, Homo sapiens
atggtgatgatgggcattcgttctg

SEQ ID NO: 15924 - DNA, 24 bp, Homo sapiens
cggctgctgtgtcaacctcatcaa

SEQ ID NO: 15925 - DNA, 25 bp, Homo sapiens
atggtgatgatgggcattcgttctg

SEQ ID NO: 15926 - DNA, 24 bp, Homo sapiens
cggctgctgtgtcaacctcatcaa

SEQ ID NO: 15927 - DNA, 25 bp, Homo sapiens
acagccttggtatagccttcacaga

SEQ ID NO: 15928 - DNA, 23 bp, Homo sapiens
cccgattcaggaagaacaggcgt

SEQ ID NO: 15929 - DNA, 25 bp, Homo sapiens
acagccttggtatagccttcacaga

SEQ ID NO: 15930 - DNA, 24 bp, Homo sapiens
cggctgctgtgtcaacctcatcaa

SEQ ID NO: 15931 - DNA, 24 bp, Homo sapiens
acaatttcccgggaccatggctaa

SEQ ID NO: 15932 - DNA, 24 bp, Homo sapiens
cacaatttcccgggaccatggcta

SEQ ID NO: 15933 - DNA, 24 bp, Homo sapiens
tcacaatttcccgggaccatggct

SEQ ID NO: 15934 - DNA, 24 bp, Homo sapiens
acacttcccaggatagcagtgcac

SEQ ID NO: 15935 - DNA, 24 bp, Homo sapiens
gacacttcccaggatagcagtgca

SEQ ID NO: 15936 - DNA, 24 bp, Homo sapiens
cgacacttcccaggatagcagtgc

SEQ ID NO: 15937 - DNA, 25 bp, Homo sapiens
ccaccatgctttacagaagaagaca

SEQ ID NO: 15938 - DNA, 25 bp, Homo sapiens
aagatggtggaattgaagtagagga

SEQ ID NO: 15939 - DNA, 25 bp, Homo sapiens
aacacagccatctgcacagagaaga

SEQ ID NO: 15940 - DNA, 23 bp, Homo sapiens
gcccagagtctccattccaccct

SEQ ID NO: 15941 - DNA, 25 bp, Homo sapiens
ttgctggaggagttgatgacttaga

SEQ ID NO: 15942 - DNA, 24 bp, Homo sapiens
atcattagccagaagcagcagcct

SEQ ID NO: 15943 - DNA, 25 bp, Homo sapiens
aacacagccatctgcacagagaaga

SEQ ID NO: 15944 - DNA, 25 bp, Homo sapiens
aagatggtggaattgaagtagagga

SEQ ID NO: 15945 - DNA, 23 bp, Homo sapiens
atgtcactgagtccaccatgctt

SEQ ID NO: 15946 - DNA, 23 bp, Homo sapiens
cacaccacactccttgccttccc

SEQ ID NO: 15947 - DNA, 23 bp, Homo sapiens
cattgtgccgtcctcgcctcagc

SEQ ID NO: 15948 - DNA, 24 bp, Homo sapiens
atcattagccagaagcagcagcct

SEQ ID NO: 15949 - DNA, 25 bp, Homo sapiens
gtgaactggctgacttgatggaatc

SEQ ID NO: 15950 - DNA, 25 bp, Homo sapiens
ccagaagggcaactgtctactgtct

SEQ ID NO: 15951 - DNA, 25 bp, Homo sapiens
ttaatggactcgtaagccagcatgg

SEQ ID NO: 15952 - DNA, 25 bp, Homo sapiens
tttcgctggcaacaaattgagaaga

SEQ ID NO: 15953 - DNA, 25 bp, Homo sapiens
cccagcctgacctcttccctttatt

SEQ ID NO: 15954 - DNA, 23 bp, Homo sapiens
gcccagagtctccattccaccct

SEQ ID NO: 15955 - DNA, 25 bp, Homo sapiens
aacacagccatctgcacagagaaga

SEQ ID NO: 15956 - DNA, 25 bp, Homo sapiens
gaacgacacttcccaggatagcagt

SEQ ID NO: 15957 - DNA, 25 bp, Homo sapiens
ttcagctcaaggcattggatgtggt

SEQ ID NO: 15958 - DNA, 25 bp, Homo sapiens
aacacagccatctgcacagagaaga

SEQ ID NO: 15959 - DNA, 25 bp, Homo sapiens
ataacgattgaggatttatggaaac

SEQ ID NO: 15960 - DNA, 25 bp, Homo sapiens
gaacgacacttcccaggatagcagt

SEQ ID NO: 15961 - DNA, 25 bp, Homo sapiens
ttcagctcaaggcattggatgtggt

SEQ ID NO: 15962 - DNA, 23 bp, Homo sapiens
ggacctctaacacgcccacctca

SEQ ID NO: 15963 - DNA, 23 bp, Homo sapiens
attggtgttggaggctgctggtt

SEQ ID NO: 15964 - DNA, 23 bp, Homo sapiens
ggacctctaacacgcccacctca

SEQ ID NO: 15965 - DNA, 25 bp, Homo sapiens
ttcagctcaaggcattggatgtggt

SEQ ID NO: 15966 - DNA, 25 bp, Homo sapiens
ttgctggaggagttgatgacttaga

SEQ ID NO: 15967 - DNA, 23 bp, Homo sapiens
gcccagagtctccattccaccct

SEQ ID NO: 15968 - DNA, 25 bp, Homo sapiens
cccagcctgacctcttccctttatt

SEQ ID NO: 15969 - DNA, 24 bp, Homo sapiens
tccctgcctcgggcctccctggga

SEQ ID NO: 15970 - DNA, 24 bp, Homo sapiens
ctccctgcctcgggcctccctggg

SEQ ID NO: 15971 - DNA, 24 bp, Homo sapiens
gctccctgcctcgggcctccctgg

SEQ ID NO: 15972 - DNA, 23 bp, Homo sapiens
aggctggtcttgaactcctgagc

SEQ ID NO: 15973 - DNA, 23 bp, Homo sapiens
gtgtccgcctgggcctcccaaag

SEQ ID NO: 15974 - DNA, 24 bp, Homo sapiens
tcacacctcgggctccctcagctc

SEQ ID NO: 15975 - DNA, 24 bp, Homo sapiens
ttcacacctcgggctccctcagct

SEQ ID NO: 15976 - DNA, 24 bp, Homo sapiens
attcacacctcgggctccctcagc

SEQ ID NO: 15977 - DNA, 24 bp, Homo sapiens
cccacgtctcgggctccctccccg

SEQ ID NO: 15978 - DNA, 24 bp, Homo sapiens
gcccacgtctcgggctccctcccc

SEQ ID NO: 15979 - DNA, 24 bp, Homo sapiens
ggcccacgtctcgggctccctccc

SEQ ID NO: 15980 - DNA, 24 bp, Homo sapiens
cttccacgcagcctgcccctgagg

SEQ ID NO: 15981 - DNA, 24 bp, Homo sapiens
ccttccacgcagcctgcccctgag

SEQ ID NO: 15982 - DNA, 24 bp, Homo sapiens
tccttccacgcagcctgcccctga

SEQ ID NO: 15983 - DNA, 24 bp, Homo sapiens
tgacctcctcagtgcagactggaa

SEQ ID NO: 15984 - DNA, 24 bp, Homo sapiens
gtgacctcctcagtgcagactgga

SEQ ID NO: 15985 - DNA, 24 bp, Homo sapiens
cgtgacctcctcagtgcagactgg

SEQ ID NO: 15986 - DNA, 23 bp, Homo sapiens
tcaggtggatgagagccgagtcc

SEQ ID NO: 15987 - DNA, 23 bp, Homo sapiens
ccctgctgcccttcctggatgcg

SEQ ID NO: 15988 - DNA, 23 bp, Homo sapiens
cagaaggtccccgtgctctttca

SEQ ID NO: 15989 - DNA, 24 bp, Homo sapiens
agctggagatgaaccccccgaccc

SEQ ID NO: 15990 - DNA, 24 bp, Homo sapiens
cagctggagatgaaccccccgacc

SEQ ID NO: 15991 - DNA, 24 bp, Homo sapiens
gcagctggagatgaaccccccgac

SEQ ID NO: 15992 - DNA, 24 bp, Homo sapiens
agttctttgtggagaatcccagtg

SEQ ID NO: 15993 - DNA, 24 bp, Homo sapiens
cagttctttgtggagaatcccagt

SEQ ID NO: 15994 - DNA, 24 bp, Homo sapiens
gcagttctttgtggagaatcccag

SEQ ID NO: 15995 - DNA, 23 bp, Homo sapiens
cgttccaacacagcagtagtggc

SEQ ID NO: 15996 - DNA, 25 bp, Homo sapiens
tggaagcactgggtctctatctctg

SEQ ID NO: 15997 - DNA, 23 bp, Homo sapiens
caccagagagcagcaagaagcgg

SEQ ID NO: 15998 - DNA, 23 bp, Homo sapiens
gtgccgccaagtatgccgccttc

SEQ ID NO: 15999 - DNA, 25 bp, Homo sapiens
aagacagatgaaagccttaccaagt

SEQ ID NO: 16000 - DNA, 23 bp, Homo sapiens
gttccattgggatcgcttccgca

SEQ ID NO: 16001 - DNA, 24 bp, Homo sapiens
atgactgaacgagatgtggagacc

SEQ ID NO: 16002 - DNA, 25 bp, Homo sapiens
ggctgacctagacatggatctgctc

SEQ ID NO: 16003 - DNA, 25 bp, Homo sapiens
ttggaaagtgaggatgatgagcggc

SEQ ID NO: 16004 - DNA, 24 bp, Homo sapiens
accgcctcatcactcgtaattcct

SEQ ID NO: 16005 - DNA, 25 bp, Homo sapiens
ggttggataaggctgtgcttcaatc

SEQ ID NO: 16006 - DNA, 25 bp, Homo sapiens
ggtcgggatggcaacattactggaa

SEQ ID NO: 16007 - DNA, 23 bp, Homo sapiens
aaccaccatcatcgcagccacag

SEQ ID NO: 16008 - DNA, 25 bp, Homo sapiens
ccagccagtgactctgtcctctgta

SEQ ID NO: 16009 - DNA, 23 bp, Homo sapiens
ggtcctccagcagccacagtctg

SEQ ID NO: 16010 - DNA, 23 bp, Homo sapiens
gcaagaaccagatggcgagactt

SEQ ID NO: 16011 - DNA, 25 bp, Homo sapiens
agaagaagaggtggatgtaactggt

SEQ ID NO: 16012 - DNA, 25 bp, Homo sapiens
attcagatgtggaagtcatgcctgc

SEQ ID NO: 16013 - DNA, 25 bp, Homo sapiens
actattcagtccattgccttcttgc

SEQ ID NO: 16014 - DNA, 23 bp, Homo sapiens
tggtcccttcttggtcattgccc

SEQ ID NO: 16015 - DNA, 24 bp, Homo sapiens
ccagcaggcagatgattcaacagt

SEQ ID NO: 16016 - DNA, 23 bp, Homo sapiens
gcttcgtgaaattgaatggcgtt

SEQ ID NO: 16017 - DNA, 24 bp, Homo sapiens
gcatacaagtttgacgctctgatc

SEQ ID NO: 16018 - DNA, 24 bp, Homo sapiens
tcattgatgaagcccatcgactga

SEQ ID NO: 16019 - DNA, 23 bp, Homo sapiens
gacaggctgccattgaccgcttc

SEQ ID NO: 16020 - DNA, 24 bp, Homo sapiens
accgcctcatcactcgtaattcct

SEQ ID NO: 16021 - DNA, 25 bp, Homo sapiens
ggttggataaggctgtgcttcaatc

SEQ ID NO: 16022 - DNA, 23 bp, Homo sapiens
tgatgggcgagttagaggcaacc

SEQ ID NO: 16023 - DNA, 23 bp, Homo sapiens
cgggctggtggacttggtattaa

SEQ ID NO: 16024 - DNA, 23 bp, Homo sapiens
ctgccattgaccgcttcagcaag

SEQ ID NO: 16025 - DNA, 25 bp, Homo sapiens
agacgaactacaaccatcaccattg

SEQ ID NO: 16026 - DNA, 25 bp, Homo sapiens
ggtcgggatggcaacattactggaa

SEQ ID NO: 16027 - DNA, 25 bp, Homo sapiens
ggttggataaggctgtgcttcaatc

SEQ ID NO: 16028 - DNA, 23 bp, Homo sapiens
gtgccgccaagtatgccgccttc

SEQ ID NO: 16029 - DNA, 25 bp, Homo sapiens
aagacagatgaaagccttaccaagt

SEQ ID NO: 16030 - DNA, 25 bp, Homo sapiens
gtggaatatgaccctgacaccatgc

SEQ ID NO: 16031 - DNA, 24 bp, Homo sapiens
ccaacttaaccaatgctctgcctc

SEQ ID NO: 16032 - DNA, 24 bp, Homo sapiens
tgggaagatggaaatcatggcagt

SEQ ID NO: 16033 - DNA, 24 bp, Homo sapiens
gctgaagaaatggaatagtgttga

SEQ ID NO: 16034 - DNA, 24 bp, Homo sapiens
taagccacattgagtcccagcagt

SEQ ID NO: 16035 - DNA, 24 bp, Homo sapiens
ttgttcccaaccgctaccctcgct

SEQ ID NO: 16036 - DNA, 24 bp, Homo sapiens
gacctcacccgcccacaccacatt

SEQ ID NO: 16037 - DNA, 23 bp, Homo sapiens
cgccttcaccgttcttgccttcc

SEQ ID NO: 16038 - DNA, 23 bp, Homo sapiens
cagtcaggccctgggtgggattg

SEQ ID NO: 16039 - DNA, 24 bp, Homo sapiens
gaagctccccctttcacacagtgc

SEQ ID NO: 16040 - DNA, 24 bp, Homo sapiens
atggagtcacgaaacagggaccga

SEQ ID NO: 16041 - DNA, 24 bp, Homo sapiens
catggagtcacgaaacagggaccg

SEQ ID NO: 16042 - DNA, 24 bp, Homo sapiens
gcatggagtcacgaaacagggacc

SEQ ID NO: 16043 - DNA, 25 bp, Homo sapiens
tgcgaaatgttgctaagatgtttgc

SEQ ID NO: 16044 - DNA, 25 bp, Homo sapiens
acagtatgataccatccatcgcttg

SEQ ID NO: 16045 - DNA, 24 bp, Homo sapiens
gtgcccaacagaggacatacgaaa

SEQ ID NO: 16046 - DNA, 24 bp, Homo sapiens
ctctcccactggccaaagcacccc

SEQ ID NO: 16047 - DNA, 24 bp, Homo sapiens
actctcccactggccaaagcaccc

SEQ ID NO: 16048 - DNA, 24 bp, Homo sapiens
gactctcccactggccaaagcacc

SEQ ID NO: 16049 - DNA, 24 bp, Homo sapiens
ctctctgcctggcccgatttcccg

SEQ ID NO: 16050 - DNA, 24 bp, Homo sapiens
actctctgcctggcccgatttccc

SEQ ID NO: 16051 - DNA, 24 bp, Homo sapiens
gactctctgcctggcccgatttcc

SEQ ID NO: 16052 - DNA, 24 bp, Homo sapiens
ctgggaccgagcgccgacattcct

SEQ ID NO: 16053 - DNA, 24 bp, Homo sapiens
gctgggaccgagcgccgacattcc

SEQ ID NO: 16054 - DNA, 24 bp, Homo sapiens
agctgggaccgagcgccgacattc

SEQ ID NO: 16055 - DNA, 24 bp, Homo sapiens
cagatccagaggtgcagtggcctg

SEQ ID NO: 16056 - DNA, 24 bp, Homo sapiens
acagatccagaggtgcagtggcct

SEQ ID NO: 16057 - DNA, 24 bp, Homo sapiens
cacagatccagaggtgcagtggcc

SEQ ID NO: 16058 - DNA, 24 bp, Homo sapiens
cgcgcgttcagcccctcggggcgt

SEQ ID NO: 16059 - DNA, 24 bp, Homo sapiens
ccgcgcgttcagcccctcggggcg

SEQ ID NO: 16060 - DNA, 24 bp, Homo sapiens
tccgcgcgttcagcccctcggggc

SEQ ID NO: 16061 - DNA, 24 bp, Homo sapiens
tgggatcccaggtgctcatccgag

SEQ ID NO: 16062 - DNA, 24 bp, Homo sapiens
atgggatcccaggtgctcatccga

SEQ ID NO: 16063 - DNA, 24 bp, Homo sapiens
gatgggatcccaggtgctcatccg

SEQ ID NO: 16064 - DNA, 24 bp, Homo sapiens
cggaggccgaggtgactgggctgc

SEQ ID NO: 16065 - DNA, 24 bp, Homo sapiens
acggaggccgaggtgactgggctg

SEQ ID NO: 16066 - DNA, 24 bp, Homo sapiens
gacggaggccgaggtgactgggct

SEQ ID NO: 16067 - DNA, 24 bp, Homo sapiens
attgccagagcccaggaatggact

SEQ ID NO: 16068 - DNA, 24 bp, Homo sapiens
ctcctccacgaaggcccagagcag

SEQ ID NO: 16069 - DNA, 24 bp, Homo sapiens
tctcccagcagccgtgcccccgag

SEQ ID NO: 16070 - DNA, 24 bp, Homo sapiens
gtctcccagcagccgtgcccccga

SEQ ID NO: 16071 - DNA, 24 bp, Homo sapiens
tgtctcccagcagccgtgcccccg

SEQ ID NO: 16072 - DNA, 24 bp, Homo sapiens
ccagcagcaagaaggcaccacata

SEQ ID NO: 16073 - DNA, 24 bp, Homo sapiens
gaggtcaaggaggagattggaagg

SEQ ID NO: 16074 - DNA, 24 bp, Homo sapiens
ccaggcatacagggagcgagacat

SEQ ID NO: 16075 - DNA, 24 bp, Homo sapiens
gcagggacactggtggctcctcca

SEQ ID NO: 16076 - DNA, 24 bp, Homo sapiens
tgcagggacactggtggctcctcc

SEQ ID NO: 16077 - DNA, 24 bp, Homo sapiens
ctgcagggacactggtggctcctc

SEQ ID NO: 16078 - DNA, 24 bp, Homo sapiens
gcccacttcatcaacaccaagcag

SEQ ID NO: 16079 - DNA, 24 bp, Homo sapiens
gctacaagtccatcctggtgatgc

SEQ ID NO: 16080 - DNA, 24 bp, Homo sapiens
tcctccagttcctcctcctcctct

SEQ ID NO: 16081 - DNA, 24 bp, Homo sapiens
tgaggatctgtccgactccacacc

SEQ ID NO: 16082 - DNA, 24 bp, Homo sapiens
aggcgtggctggctatggcacctt

SEQ ID NO: 16083 - DNA, 24 bp, Homo sapiens
atgggaggacatcgggcaggtctc

SEQ ID NO: 16084 - DNA, 24 bp, Homo sapiens
gctgaggatctgtccgactccaca

SEQ ID NO: 16085 - DNA, 24 bp, Homo sapiens
aggcgtggctggctatggcacctt

SEQ ID NO: 16086 - DNA, 24 bp, Homo sapiens
cgcaagttctccctgggtggtcgc

SEQ ID NO: 16087 - DNA, 24 bp, Homo sapiens
aggcgtggctggctatggcacctt

SEQ ID NO: 16088 - DNA, 24 bp, Homo sapiens
cgcaagttctccctgggtggtcgc

SEQ ID NO: 16089 - DNA, 24 bp, Homo sapiens
tgaggatctgtccgactccacacc

SEQ ID NO: 16090 - DNA, 24 bp, Homo sapiens
ctgggaccgagacggagcccccct

SEQ ID NO: 16091 - DNA, 24 bp, Homo sapiens
gctgggaccgagacggagcccccc

SEQ ID NO: 16092 - DNA, 24 bp, Homo sapiens
agctgggaccgagacggagccccc

SEQ ID NO: 16093 - DNA, 24 bp, Homo sapiens
ggtctggaagcccgtggaatccta

SEQ ID NO: 16094 - DNA, 24 bp, Homo sapiens
cctccgacatctttgactgctgct

SEQ ID NO: 16095 - DNA, 24 bp, Homo sapiens
ggcatgtgtcagcaaggcaggaat

SEQ ID NO: 16096 - DNA, 24 bp, Homo sapiens
cctacggccctgtgacctacattg

SEQ ID NO: 16097 - DNA, 24 bp, Homo sapiens
gggtgctgctggtctggaagcccg

SEQ ID NO: 16098 - DNA, 24 bp, Homo sapiens
atgcccggatatcggggaggtgta

SEQ ID NO: 16099 - DNA, 24 bp, Homo sapiens
cctccgacatctttgactgctgct

SEQ ID NO: 16100 - DNA, 24 bp, Homo sapiens
ggcatgtgtcagcaaggcaggaat

SEQ ID NO: 16101 - DNA, 24 bp, Homo sapiens
agaccttcgcattccagacacaga

SEQ ID NO: 16102 - DNA, 24 bp, Homo sapiens
gcccagcacaaagaccttcgcatt

SEQ ID NO: 16103 - DNA, 24 bp, Homo sapiens
ggcatgtgtcagcaaggcaggaat

SEQ ID NO: 16104 - DNA, 24 bp, Homo sapiens
cctccgacatctttgactgctgct

SEQ ID NO: 16105 - DNA, 24 bp, Homo sapiens
agcaacccagtgtttgagattcca

SEQ ID NO: 16106 - DNA, 24 bp, Homo sapiens
ggaggagaggaggcttcagagtcg

SEQ ID NO: 16107 - DNA, 24 bp, Homo sapiens
gggaagagttcttgggcaaagcgt

SEQ ID NO: 16108 - DNA, 24 bp, Homo sapiens
tgtcgccctagcccaggcccacgc

SEQ ID NO: 16109 - DNA, 24 bp, Homo sapiens
ctgtcgccctagcccaggcccacg

SEQ ID NO: 16110 - DNA, 24 bp, Homo sapiens
cctgtcgccctagcccaggcccac

SEQ ID NO: 16111 - DNA, 24 bp, Homo sapiens
aatgctaaagacctgcttgcctgg

SEQ ID NO: 16112 - DNA, 24 bp, Homo sapiens
tgcctgctgccatgtttccttact

SEQ ID NO: 16113 - DNA, 24 bp, Homo sapiens
tccgtgattgctgggataccacct

SEQ ID NO: 16114 - DNA, 24 bp, Homo sapiens
ctctccgtcaggaccgcgacggca

SEQ ID NO: 16115 - DNA, 24 bp, Homo sapiens
gctctccgtcaggaccgcgacggc

SEQ ID NO: 16116 - DNA, 24 bp, Homo sapiens
cgctctccgtcaggaccgcgacgg

SEQ ID NO: 16117 - DNA, 24 bp, Homo sapiens
ctactcgggaggctgaggcaggag

SEQ ID NO: 16118 - DNA, 24 bp, Homo sapiens
gctactcgggaggctgaggcagga

SEQ ID NO: 16119 - DNA, 24 bp, Homo sapiens
agctactcgggaggctgaggcagg

SEQ ID NO: 16120 - DNA, 24 bp, Homo sapiens
gcgaggctgaggcggccggcgcgg

SEQ ID NO: 16121 - DNA, 24 bp, Homo sapiens
ggcgaggctgaggcggccggcgcg

SEQ ID NO: 16122 - DNA, 24 bp, Homo sapiens
cggcgaggctgaggcggccggcgc

SEQ ID NO: 16123 - DNA, 24 bp, Homo sapiens
tgagaaatgtgatcatccagcggg

SEQ ID NO: 16124 - DNA, 24 bp, Homo sapiens
atgagaaatgtgatcatccagcgg

SEQ ID NO: 16125 - DNA, 24 bp, Homo sapiens
aatgagaaatgtgatcatccagcg

SEQ ID NO: 16126 - DNA, 24 bp, Homo sapiens
aggtgccatttgtgccatagatta

SEQ ID NO: 16127 - DNA, 24 bp, Homo sapiens
tttactaaaagctgggaaaatacc

SEQ ID NO: 16128 - DNA, 24 bp, Homo sapiens
atttaatgtatttaatttaataca

SEQ ID NO: 16129 - DNA, 24 bp, Homo sapiens
attcactgcagggatggatctcag

SEQ ID NO: 16130 - DNA, 24 bp, Homo sapiens
cattcactgcagggatggatctca

SEQ ID NO: 16131 - DNA, 24 bp, Homo sapiens
tcattcactgcagggatggatctc

SEQ ID NO: 16132 - DNA, 24 bp, Homo sapiens
tgctatctcagatgtcccaggaga

SEQ ID NO: 16133 - DNA, 24 bp, Homo sapiens
atgctatctcagatgtcccaggag

SEQ ID NO: 16134 - DNA, 24 bp, Homo sapiens
aatgctatctcagatgtcccagga

SEQ ID NO: 16135 - DNA, 24 bp, Homo sapiens
tctgattgcagatgtcccaggaga

SEQ ID NO: 16136 - DNA, 24 bp, Homo sapiens
ttctgattgcagatgtcccaggag

SEQ ID NO: 16137 - DNA, 24 bp, Homo sapiens
cttctgattgcagatgtcccagga

SEQ ID NO: 16138 - DNA, 24 bp, Homo sapiens
cacaacaatagctactactccatc

SEQ ID NO: 16139 - DNA, 24 bp, Homo sapiens
ccacaacaatagctactactccat

SEQ ID NO: 16140 - DNA, 24 bp, Homo sapiens
accacaacaatagctactactcca

SEQ ID NO: 16141 - DNA, 25 bp, Homo sapiens
ggcttaaactcttggcatttggctt

SEQ ID NO: 16142 - DNA, 24 bp, Homo sapiens
gctgacttccagatatgaccatgt

SEQ ID NO: 16143 - DNA, 24 bp, Homo sapiens
acagaagtatttgtgacagggcaa

SEQ ID NO: 16144 - DNA, 25 bp, Homo sapiens
accacaacttctcttagtccagaca

SEQ ID NO: 16145 - DNA, 25 bp, Homo sapiens
acctactcacaccactgcattctca

SEQ ID NO: 16146 - DNA, 23 bp, Homo sapiens
tgcccagtgttccactttcaagt

SEQ ID NO: 16147 - DNA, 24 bp, Homo sapiens
cagccagcacctttcctacagacc

SEQ ID NO: 16148 - DNA, 23 bp, Homo sapiens
cccattgacaaccaccctcagcc

SEQ ID NO: 16149 - DNA, 23 bp, Homo sapiens
ttacctgcacgcacctccaacac

SEQ ID NO: 16150 - DNA, 25 bp, Homo sapiens
tctgaaacaaccactctgagccctt

SEQ ID NO: 16151 - DNA, 24 bp, Homo sapiens
agcgaacacctcagatgcctacct

SEQ ID NO: 16152 - DNA, 24 bp, Homo sapiens
cagccagcacctttcctacagacc

SEQ ID NO: 16153 - DNA, 25 bp, Homo sapiens
ggaggatgatttgggaacagaaagc

SEQ ID NO: 16154 - DNA, 25 bp, Homo sapiens
cactcgatgtgaagaaggaaacagg

SEQ ID NO: 16155 - DNA, 25 bp, Homo sapiens
ggagtccaggagagcctcagattat

SEQ ID NO: 16156 - DNA, 25 bp, Homo sapiens
gaagtgaagctgcacatcaaggagt

SEQ ID NO: 16157 - DNA, 25 bp, Homo sapiens
acgtaatggaagtgctgcaatgtgt

SEQ ID NO: 16158 - DNA, 25 bp, Homo sapiens
aaggcactgatagcatttctggcat

SEQ ID NO: 16159 - DNA, 25 bp, Homo sapiens
acaatggagactatcctggagaacc

SEQ ID NO: 16160 - DNA, 23 bp, Homo sapiens
aagtgctcctccaagccaggtct

SEQ ID NO: 16161 - DNA, 25 bp, Homo sapiens
agggtcaaactacataaatgccagc

SEQ ID NO: 16162 - DNA, 25 bp, Homo sapiens
ggaggatgatttgggaacagaaagc

SEQ ID NO: 16163 - DNA, 25 bp, Homo sapiens
aagaaggaaacaggaacaagtgtgc

SEQ ID NO: 16164 - DNA, 25 bp, Homo sapiens
agggtcaaactacataaatgccagc

SEQ ID NO: 16165 - DNA, 25 bp, Homo sapiens
ggaggatgatttgggaacagaaagc

SEQ ID NO: 16166 - DNA, 23 bp, Homo sapiens
ccgtcaatggaagagggcactcg

SEQ ID NO: 16167 - DNA, 25 bp, Homo sapiens
tcggaattgatgccatgctagaagg

SEQ ID NO: 16168 - DNA, 25 bp, Homo sapiens
gcgacagagatgcctgatggttcaa

SEQ ID NO: 16169 - DNA, 25 bp, Homo sapiens
ccagtacatcttgatccatcaggct

SEQ ID NO: 16170 - DNA, 25 bp, Homo sapiens
gacagtgattcagaggaaccaagca

SEQ ID NO: 16171 - DNA, 25 bp, Homo sapiens
aacctgaagtgatgattgctgctca

SEQ ID NO: 16172 - DNA, 25 bp, Homo sapiens
ggagaccaggaaatctgtgctcagt

SEQ ID NO: 16173 - DNA, 23 bp, Homo sapiens
ctggaggacacagcacattggaa

SEQ ID NO: 16174 - DNA, 25 bp, Homo sapiens
ccagtacatcttgatccatcaggct

SEQ ID NO: 16175 - DNA, 25 bp, Homo sapiens
gcgacagagatgcctgatggttcaa

SEQ ID NO: 16176 - DNA, 24 bp, Homo sapiens
agggaccactgaaggagaccattg

SEQ ID NO: 16177 - DNA, 25 bp, Homo sapiens
ggagaccaggaaatctgtgctcagt

SEQ ID NO: 16178 - DNA, 25 bp, Homo sapiens
ggaacaagcatcacaagagtacacc

SEQ ID NO: 16179 - DNA, 23 bp, Homo sapiens
actggagtgtggagcagcttcct

SEQ ID NO: 16180 - DNA, 25 bp, Homo sapiens
ggaacaagcatcacaagagtacacc

SEQ ID NO: 16181 - DNA, 24 bp, Homo sapiens
agggatggatctcagcaaacggga

SEQ ID NO: 16182 - DNA, 25 bp, Homo sapiens
ggaacaagcatcacaagagtacacc

SEQ ID NO: 16183 - DNA, 25 bp, Homo sapiens
aatatacaaactggagtgtggagca

SEQ ID NO: 16184 - DNA, 25 bp, Homo sapiens
tgcagaacccaaggaattaatctct

SEQ ID NO: 16185 - DNA, 25 bp, Homo sapiens
agtgcggaaacagaagaggtagtgg

SEQ ID NO: 16186 - DNA, 25 bp, Homo sapiens
cacctaccctgctcagaatggacaa

SEQ ID NO: 16187 - DNA, 25 bp, Homo sapiens
atgaagtggacaaagtaaagcagga

SEQ ID NO: 16188 - DNA, 25 bp, Homo sapiens
ggaacaagcatcacaagagtacacc

SEQ ID NO: 16189 - DNA, 23 bp, Homo sapiens
actggagtgtggagcagcttcct

SEQ ID NO: 16190 - DNA, 25 bp, Homo sapiens
ggagaccaggaaatctgtgctcagt

SEQ ID NO: 16191 - DNA, 24 bp, Homo sapiens
acacaagtgacagtgctgatggcc

SEQ ID NO: 16192 - DNA, 24 bp, Homo sapiens
agtgctgatggcccttctgattgc

SEQ ID NO: 16193 - DNA, 24 bp, Homo sapiens
agtgacagtgctgatggcccttct

SEQ ID NO: 16194 - DNA, 24 bp, Homo sapiens
gctatctcagacacaagtgacagt

SEQ ID NO: 16195 - DNA, 24 bp, Homo sapiens
tgctatctcagacacaagtgacag

SEQ ID NO: 16196 - DNA, 24 bp, Homo sapiens
caatgctatctcagacacaagtga

SEQ ID NO: 16197 - DNA, 24 bp, Homo sapiens
caccggggaagctggtcacccttc

SEQ ID NO: 16198 - DNA, 24 bp, Homo sapiens
ccaccggggaagctggtcaccctt

SEQ ID NO: 16199 - DNA, 24 bp, Homo sapiens
accaccggggaagctggtcaccct

SEQ ID NO: 16200 - DNA, 24 bp, Homo sapiens
ggctcctaccgggcttgtgtggct

SEQ ID NO: 16201 - DNA, 24 bp, Homo sapiens
gggctcctaccgggcttgtgtggc

SEQ ID NO: 16202 - DNA, 24 bp, Homo sapiens
tgggctcctaccgggcttgtgtgg

SEQ ID NO: 16203 - DNA, 24 bp, Homo sapiens
cctggagcaatggcaatggcactg

SEQ ID NO: 16204 - DNA, 24 bp, Homo sapiens
gcattggaagccatgaggagttga

SEQ ID NO: 16205 - DNA, 24 bp, Homo sapiens
agacttcaggtcaatatctcgggc

SEQ ID NO: 16206 - DNA, 24 bp, Homo sapiens
tgtgtttgcagagctataaacagc

SEQ ID NO: 16207 - DNA, 24 bp, Homo sapiens
ttgtgtttgcagagctataaacag

SEQ ID NO: 16208 - DNA, 24 bp, Homo sapiens
tttgtgtttgcagagctataaaca

SEQ ID NO: 16209 - DNA, 24 bp, Homo sapiens
acctctgtgcctgcttcccaagtt

SEQ ID NO: 16210 - DNA, 24 bp, Homo sapiens
gatgcgatcctggaagcctgtctt

SEQ ID NO: 16211 - DNA, 24 bp, Homo sapiens
acatctacaactgcgtcagggagc

SEQ ID NO: 16212 - DNA, 24 bp, Homo sapiens
tgggattacaggtgcctgccacca

SEQ ID NO: 16213 - DNA, 24 bp, Homo sapiens
ctgggattacaggtgcctgccacc

SEQ ID NO: 16214 - DNA, 24 bp, Homo sapiens
gctgggattacaggtgcctgccac

SEQ ID NO: 16215 - DNA, 24 bp, Homo sapiens
actccacctggaccttatggctcc

SEQ ID NO: 16216 - DNA, 24 bp, Homo sapiens
gcaattcagcccaacaggaggaca

SEQ ID NO: 16217 - DNA, 24 bp, Homo sapiens
cccattacgatttcatctctgccc

SEQ ID NO: 16218 - DNA, 24 bp, Homo sapiens
ctgcagccccggtcccgcctgact

SEQ ID NO: 16219 - DNA, 24 bp, Homo sapiens
cctgcagccccggtcccgcctgac

SEQ ID NO: 16220 - DNA, 24 bp, Homo sapiens
ccctgcagccccggtcccgcctga

SEQ ID NO: 16221 - DNA, 23 bp, Homo sapiens
gctcaagcgatcctcctgcctca

SEQ ID NO: 16222 - DNA, 23 bp, Homo sapiens
gtcttgctctgttgaccaggctg

SEQ ID NO: 16223 - DNA, 24 bp, Homo sapiens
ggtgatcctcctgcctcaacttcc

SEQ ID NO: 16224 - DNA, 23 bp, Homo sapiens
tcaagtgatccaccagcctcagc

SEQ ID NO: 16225 - DNA, 23 bp, Homo sapiens
ttgcccaggctggtctcgaactc

SEQ ID NO: 16226 - DNA, 24 bp, Homo sapiens
tgatagtcgagaaggagaacttat

SEQ ID NO: 16227 - DNA, 24 bp, Homo sapiens
atgatagtcgagaaggagaactta

SEQ ID NO: 16228 - DNA, 24 bp, Homo sapiens
gatgatagtcgagaaggagaactt

SEQ ID NO: 16229 - DNA, 24 bp, Homo sapiens
cagaactgcaaacaatcgggagaa

SEQ ID NO: 16230 - DNA, 24 bp, Homo sapiens
ccagaactgcaaacaatcgggaga

SEQ ID NO: 16231 - DNA, 24 bp, Homo sapiens
gccagaactgcaaacaatcgggag

SEQ ID NO: 16232 - DNA, 24 bp, Homo sapiens
aaaggacgaagaggagaaacaagc

SEQ ID NO: 16233 - DNA, 25 bp, Homo sapiens
agaaacagcgaagcaaacggactca

SEQ ID NO: 16234 - DNA, 25 bp, Homo sapiens
tgccaaaggagactcagggaatgaa

SEQ ID NO: 16235 - DNA, 25 bp, Homo sapiens
acttagttcatcctcggctccaaca

SEQ ID NO: 16236 - DNA, 24 bp, Homo sapiens
ggaactcacggtcctgctgatgac

SEQ ID NO: 16237 - DNA, 25 bp, Homo sapiens
aacacagatgatgacattcttggaa

SEQ ID NO: 16238 - DNA, 24 bp, Homo sapiens
tgcgaacactcagccaactccatt

SEQ ID NO: 16239 - DNA, 25 bp, Homo sapiens
gttgccaatacacaatcaggatgct

SEQ ID NO: 16240 - DNA, 25 bp, Homo sapiens
cacaatcctcttatcctgatgccag

SEQ ID NO: 16241 - DNA, 25 bp, Homo sapiens
ccttactctcagccaccagcaacac

SEQ ID NO: 16242 - DNA, 25 bp, Homo sapiens
actccacgacctgttgtagattctt

SEQ ID NO: 16243 - DNA, 24 bp, Homo sapiens
aggcatcaaggcgattgtctgttg

SEQ ID NO: 16244 - DNA, 24 bp, Homo sapiens
aatggtattctcagagcaggcagc

SEQ ID NO: 16245 - DNA, 25 bp, Homo sapiens
agatgtcaacggtcaggagtccact

SEQ ID NO: 16246 - DNA, 25 bp, Homo sapiens
gttccagatcggttcaagtccacac

SEQ ID NO: 16247 - DNA, 23 bp, Homo sapiens
ggacagaaccttggaccacaggc

SEQ ID NO: 16248 - DNA, 25 bp, Homo sapiens
cagcgtaagcagtatgaagagtggc

SEQ ID NO: 16249 - DNA, 25 bp, Homo sapiens
gcagcagaagtatcttgaagaacaa

SEQ ID NO: 16250 - DNA, 25 bp, Homo sapiens
gaaacagcgaagcaaacggactcag

SEQ ID NO: 16251 - DNA, 24 bp, Homo sapiens
aaaggacgaagaggagaaacaagc

SEQ ID NO: 16252 - DNA, 25 bp, Homo sapiens
gagaaagcagcacctcgctcaaaga

SEQ ID NO: 16253 - DNA, 25 bp, Homo sapiens
ccattccttcattgccacaatcacc

SEQ ID NO: 16254 - DNA, 25 bp, Homo sapiens
tcagtacagcaacaacatctccact

SEQ ID NO: 16255 - DNA, 23 bp, Homo sapiens
cccatcgccttccctcctgcttt

SEQ ID NO: 16256 - DNA, 25 bp, Homo sapiens
cactggagaactgaacgcaccttat

SEQ ID NO: 16257 - DNA, 25 bp, Homo sapiens
ttcactccaagtcatcgcagtaccg

SEQ ID NO: 16258 - DNA, 25 bp, Homo sapiens
tgtatctggcacggtctcggattca

SEQ ID NO: 16259 - DNA, 24 bp, Homo sapiens
ttggagccatggatgatcctttca

SEQ ID NO: 16260 - DNA, 24 bp, Homo sapiens
tttggagccatggatgatcctttc

SEQ ID NO: 16261 - DNA, 24 bp, Homo sapiens
ttttggagccatggatgatccttt

SEQ ID NO: 16262 - DNA, 23 bp, Homo sapiens
gacactcctgctctgcctccgaa

SEQ ID NO: 16263 - DNA, 25 bp, Homo sapiens
tctgtaagttgagtcctccgcctcc

SEQ ID NO: 16264 - DNA, 24 bp, Homo sapiens
cttggttccgcagactttcccgag

SEQ ID NO: 16265 - DNA, 23 bp, Homo sapiens
ttcatcctccagtgtctcctcaa

SEQ ID NO: 16266 - DNA, 23 bp, Homo sapiens
gctctgccactgacgacttcttc

SEQ ID NO: 16267 - DNA, 25 bp, Homo sapiens
gcagaacagcagacaacttcaacag

SEQ ID NO: 16268 - DNA, 24 bp, Homo sapiens
cttggttccgcagactttcccgag

SEQ ID NO: 16269 - DNA, 24 bp, Homo sapiens
ctcgggctttgcagacttcacctc

SEQ ID NO: 16270 - DNA, 23 bp, Homo sapiens
gcggcgacccgttccaaagtaaa

SEQ ID NO: 16271 - DNA, 24 bp, Homo sapiens
gggagtttactggcgtgaaggagc

SEQ ID NO: 16272 - DNA, 23 bp, Homo sapiens
tcaagaccgcctggacgagatgg

SEQ ID NO: 16273 - DNA, 25 bp, Homo sapiens
cagaagtgccaggatgagactcaga

SEQ ID NO: 16274 - DNA, 23 bp, Homo sapiens
caagaccgcctggacgagatgga

SEQ ID NO: 16275 - DNA, 25 bp, Homo sapiens
cagaagtgccaggatgagactcaga

SEQ ID NO: 16276 - DNA, 25 bp, Homo sapiens
ggaagacgatctgaaccgagccaag

SEQ ID NO: 16277 - DNA, 25 bp, Homo sapiens
cgagaaaaggaagaggcaatcagac

SEQ ID NO: 16278 - DNA, 25 bp, Homo sapiens
ggaagacgatctgaaccgagccaag

SEQ ID NO: 16279 - DNA, 25 bp, Homo sapiens
acgaaatcaaccaggcaaggagcaa

SEQ ID NO: 16280 - DNA, 23 bp, Homo sapiens
aggagcctggagcagtatgacca

SEQ ID NO: 16281 - DNA, 25 bp, Homo sapiens
ggaagacgatctgaaccgagccaag

SEQ ID NO: 16282 - DNA, 25 bp, Homo sapiens
cagaagtgccaggatgagactcaga

SEQ ID NO: 16283 - DNA, 23 bp, Homo sapiens
tcaagaccgcctggacgagatgg

SEQ ID NO: 16284 - DNA, 24 bp, Homo sapiens
cttatcaagagcgccttaagaatt

SEQ ID NO: 16285 - DNA, 24 bp, Homo sapiens
gcttatcaagagcgccttaagaat

SEQ ID NO: 16286 - DNA, 24 bp, Homo sapiens
tgcttatcaagagcgccttaagaa

SEQ ID NO: 16287 - DNA, 24 bp, Homo sapiens
gctggaagagagtacaaggtgctt

SEQ ID NO: 16288 - DNA, 25 bp, Homo sapiens
cttcaagccttcggattctgtgagt

SEQ ID NO: 16289 - DNA, 25 bp, Homo sapiens
tgacgatgaagaagccttggatgaa

SEQ ID NO: 16290 - DNA, 24 bp, Homo sapiens
ctcccactcctccaccgaggcctg

SEQ ID NO: 16291 - DNA, 24 bp, Homo sapiens
cctcccactcctccaccgaggcct

SEQ ID NO: 16292 - DNA, 24 bp, Homo sapiens
acctcccactcctccaccgaggcc

SEQ ID NO: 16293 - DNA, 23 bp, Homo sapiens
gtgctgggattacaggtgtgagc

SEQ ID NO: 16294 - DNA, 24 bp, Homo sapiens
ttcatgatccaccctcctcagcct

SEQ ID NO: 16295 - DNA, 23 bp, Homo sapiens
gttggccaggatggtcttgatct

SEQ ID NO: 16296 - DNA, 24 bp, Homo sapiens
gtgggagacggagctgtaggtaaa

SEQ ID NO: 16297 - DNA, 24 bp, Homo sapiens
ggtgggagacggagctgtaggtaa

SEQ ID NO: 16298 - DNA, 24 bp, Homo sapiens
tggtgggagacggagctgtaggta

SEQ ID NO: 16299 - DNA, 24 bp, Homo sapiens
ttttcggccaggtgtggttgacct

SEQ ID NO: 16300 - DNA, 24 bp, Homo sapiens
cttttcggccaggtgtggttgacc

SEQ ID NO: 16301 - DNA, 24 bp, Homo sapiens
gcttttcggccaggtgtggttgac

SEQ ID NO: 16302 - DNA, 24 bp, Homo sapiens
agatggaacaaaaggactcagcag

SEQ ID NO: 16303 - DNA, 24 bp, Homo sapiens
gcatcagggggcgatcaagatcag

SEQ ID NO: 16304 - DNA, 24 bp, Homo sapiens
accaaagcccatgtgttcgagtgt

SEQ ID NO: 16305 - DNA, 24 bp, Homo sapiens
gagagcagcgtggagagtatcatc

SEQ ID NO: 16306 - DNA, 24 bp, Homo sapiens
tggcattacggacatcaggacatc

SEQ ID NO: 16307 - DNA, 24 bp, Homo sapiens
acatcaggacatctcttactggga

SEQ ID NO: 16308 - DNA, 24 bp, Homo sapiens
cgaatctatcacaggaaagccaaa

SEQ ID NO: 16309 - DNA, 24 bp, Homo sapiens
ttgcagactgtaatgaagcattca

SEQ ID NO: 16310 - DNA, 24 bp, Homo sapiens
gcttgaatcagagtagagtggaag

SEQ ID NO: 16311 - DNA, 24 bp, Homo sapiens
agagaagaagttgggaacatcagt

SEQ ID NO: 16312 - DNA, 24 bp, Homo sapiens
agccactgcctgacttagatgaca

SEQ ID NO: 16313 - DNA, 24 bp, Homo sapiens
ggtgtggttgacctgcctgaggaa

SEQ ID NO: 16314 - DNA, 24 bp, Homo sapiens
tggcattacggacatcaggacatc

SEQ ID NO: 16315 - DNA, 24 bp, Homo sapiens
ggcgatcaagatcaggaagaaaga

SEQ ID NO: 16316 - DNA, 24 bp, Homo sapiens
tattgagctgacacaggaagaacc

SEQ ID NO: 16317 - DNA, 24 bp, Homo sapiens
tgacatcatcgcaacacctggacc

SEQ ID NO: 16318 - DNA, 24 bp, Homo sapiens
tgggttgtgtttgtgttctgatgg

SEQ ID NO: 16319 - DNA, 24 bp, Homo sapiens
aagacagctacgtgggtgacgaag

SEQ ID NO: 16320 - DNA, 24 bp, Homo sapiens
gcaaaagaggaatcctgaccctga

SEQ ID NO: 16321 - DNA, 24 bp, Homo sapiens
ctcccacaaaggtaacaaaggaat

SEQ ID NO: 16322 - DNA, 24 bp, Homo sapiens
actcccacaaaggtaacaaaggaa

SEQ ID NO: 16323 - DNA, 24 bp, Homo sapiens
tactcccacaaaggtaacaaagga

SEQ ID NO: 16324 - DNA, 24 bp, Homo sapiens
accagaaaaggcaaaagagaagaa

SEQ ID NO: 16325 - DNA, 24 bp, Homo sapiens
caccagaaaaggcaaaagagaaga

SEQ ID NO: 16326 - DNA, 24 bp, Homo sapiens
acaccagaaaaggcaaaagagaag

SEQ ID NO: 16327 - DNA, 24 bp, Homo sapiens
aggaagctcaaaaatctcagacag

SEQ ID NO: 16328 - DNA, 24 bp, Homo sapiens
caggaagctcaaaaatctcagaca

SEQ ID NO: 16329 - DNA, 24 bp, Homo sapiens
tcaggaagctcaaaaatctcagac

SEQ ID NO: 16330 - DNA, 24 bp, Homo sapiens
gagccaatcagggcacatgttgct

SEQ ID NO: 16331 - DNA, 24 bp, Homo sapiens
tgagccaatcagggcacatgttgc

SEQ ID NO: 16332 - DNA, 24 bp, Homo sapiens
ctgagccaatcagggcacatgttg

SEQ ID NO: 16333 - DNA, 24 bp, Homo sapiens
agtgaatctccttcctcagcctcc

SEQ ID NO: 16334 - DNA, 24 bp, Homo sapiens
gttgggattacaggtgcctgccac

SEQ ID NO: 16335 - DNA, 24 bp, Homo sapiens
gctcaatgcagccttcatctccca

SEQ ID NO: 16336 - DNA, 24 bp, Homo sapiens
aaccaacagttgaagagaaggcaa

SEQ ID NO: 16337 - DNA, 24 bp, Homo sapiens
ttgtggagtctgtagtgatactga

SEQ ID NO: 16338 - DNA, 24 bp, Homo sapiens
tgatacagattctacaagccaagg

SEQ ID NO: 16339 - DNA, 24 bp, Homo sapiens
aaccaacagttgaagagaaggcaa

SEQ ID NO: 16340 - DNA, 24 bp, Homo sapiens
gtggagtctgtagtgatactgatg

SEQ ID NO: 16341 - DNA, 24 bp, Homo sapiens
atggggaagactttcaatcagagc

SEQ ID NO: 16342 - DNA, 24 bp, Homo sapiens
aatcctcccaccataacctcctga

SEQ ID NO: 16343 - DNA, 23 bp, Homo sapiens
gctggagtgcagtggtgtgaaca

SEQ ID NO: 16344 - DNA, 23 bp, Homo sapiens
actgcagcttcaacctcccaggg

SEQ ID NO: 16345 - DNA, 24 bp, Homo sapiens
ctgctgactgggtctgttctatag

SEQ ID NO: 16346 - DNA, 24 bp, Homo sapiens
actgctgactgggtctgttctata

SEQ ID NO: 16347 - DNA, 24 bp, Homo sapiens
tactgctgactgggtctgttctat

SEQ ID NO: 16348 - DNA, 24 bp, Homo sapiens
agtgattctcctgcctcagcctcc

SEQ ID NO: 16349 - DNA, 24 bp, Homo sapiens
atctcactgcagcctccgcctcct

SEQ ID NO: 16350 - DNA, 25 bp, Homo sapiens
gccgcagagaagactatgttggtgg

SEQ ID NO: 16351 - DNA, 25 bp, Homo sapiens
tcagcaagagatggtcacaatcaga

SEQ ID NO: 16352 - DNA, 25 bp, Homo sapiens
agatacagagaagttccaccaccat

SEQ ID NO: 16353 - DNA, 25 bp, Homo sapiens
cagtcctgtgcggaaatctgaagaa

SEQ ID NO: 16354 - DNA, 25 bp, Homo sapiens
attcaggttcctcaatccaaatggg

SEQ ID NO: 16355 - DNA, 25 bp, Homo sapiens
cctgagaaagaaagtgagccatccg

SEQ ID NO: 16356 - DNA, 23 bp, Homo sapiens
aagcaatgatgtcgcaatctggc

SEQ ID NO: 16357 - DNA, 23 bp, Homo sapiens
gtccaccacctccatcttacacg

SEQ ID NO: 16358 - DNA, 25 bp, Homo sapiens
aggtgcaatgcttaccaacactgga

SEQ ID NO: 16359 - DNA, 25 bp, Homo sapiens
cctggacattatattaagaattgcc

SEQ ID NO: 16360 - DNA, 23 bp, Homo sapiens
gtccaccacctccatcttacacg

SEQ ID NO: 16361 - DNA, 23 bp, Homo sapiens
aagcaatgatgtcgcaatctggc

SEQ ID NO: 16362 - DNA, 23 bp, Homo sapiens
acgctacagttctcctaccgcag

SEQ ID NO: 16363 - DNA, 24 bp, Homo sapiens
ccagtaacaggaacaacaggacat

SEQ ID NO: 16364 - DNA, 25 bp, Homo sapiens
tcgctccttcttcaagcattactgc

SEQ ID NO: 16365 - DNA, 24 bp, Homo sapiens
ggcgacagagcaagactccatctc

SEQ ID NO: 16366 - DNA, 24 bp, Homo sapiens
gagcggatcacgaggtcaggagat

SEQ ID NO: 16367 - DNA, 24 bp, Homo sapiens
gcggcaggagaatggtgtgaacct

SEQ ID NO: 16368 - DNA, 24 bp, Homo sapiens
gggaggctgcggcaggagaatggt

SEQ ID NO: 16369 - DNA, 24 bp, Homo sapiens
tgggaggctgcggcaggagaatgg

SEQ ID NO: 16370 - DNA, 24 bp, Homo sapiens
ttgggaggctgcggcaggagaatg

SEQ ID NO: 16371 - DNA, 24 bp, Homo sapiens
gagcggatcacgaggtcaggagat

SEQ ID NO: 16372 - DNA, 24 bp, Homo sapiens
ctcacgcctgtaatcccagcactt

SEQ ID NO: 16373 - DNA, 24 bp, Homo sapiens
aaattagccgggcgcagtggcagg

SEQ ID NO: 16374 - DNA, 24 bp, Homo sapiens
gcaatcctcccatgttagcttccc

SEQ ID NO: 16375 - DNA, 24 bp, Homo sapiens
gttgtgctaccacgcctggctaat

SEQ ID NO: 16376 - DNA, 24 bp, Homo sapiens
gttgcccaggctctctcaaactcc

SEQ ID NO: 16377 - DNA, 24 bp, Homo sapiens
gcacctagccagaacatcgttaat

SEQ ID NO: 16378 - DNA, 24 bp, Homo sapiens
gttgtgctaccacgcctggctaat

SEQ ID NO: 16379 - DNA, 24 bp, Homo sapiens
caggctagagtgcagtggtgtgat

SEQ ID NO: 16380 - DNA, 24 bp, Homo sapiens
cccggagccaggtgtatagaagtg

SEQ ID NO: 16381 - DNA, 24 bp, Homo sapiens
gcccggagccaggtgtatagaagt

SEQ ID NO: 16382 - DNA, 24 bp, Homo sapiens
ggcccggagccaggtgtatagaag

SEQ ID NO: 16383 - DNA, 24 bp, Homo sapiens
aagggtgactgaagttcgtgctga

SEQ ID NO: 16384 - DNA, 24 bp, Homo sapiens
ggtcatgccacctcagaacctgga

SEQ ID NO: 16385 - DNA, 24 bp, Homo sapiens
cctgctgccttgaggtcgtcactt

SEQ ID NO: 16386 - DNA, 24 bp, Homo sapiens
ttcctgttgaggaggcaagtggtc

SEQ ID NO: 16387 - DNA, 24 bp, Homo sapiens
gttcctgttgaggaggcaagtggt

SEQ ID NO: 16388 - DNA, 24 bp, Homo sapiens
ggttcctgttgaggaggcaagtgg

SEQ ID NO: 16389 - DNA, 24 bp, Homo sapiens
aaatggcaaaggtgagttgagagc

SEQ ID NO: 16390 - DNA, 24 bp, Homo sapiens
caaatggcaaaggtgagttgagag

SEQ ID NO: 16391 - DNA, 24 bp, Homo sapiens
tcaaatggcaaaggtgagttgaga

SEQ ID NO: 16392 - DNA, 25 bp, Homo sapiens
ggtgtgaaggctgaacaatcatgga

SEQ ID NO: 16393 - DNA, 25 bp, Homo sapiens
agaccatgaagacttatccaagtgc

SEQ ID NO: 16394 - DNA, 25 bp, Homo sapiens
tgtgctttaggaaattattgacagt

SEQ ID NO: 16395 - DNA, 25 bp, Homo sapiens
ccagcaccaccagcagtaataacaa

SEQ ID NO: 16396 - DNA, 25 bp, Homo sapiens
cagcagtagcaactcaggatgggat

SEQ ID NO: 16397 - DNA, 25 bp, Homo sapiens
caggacctggtgaagctctgtcaac

SEQ ID NO: 16398 - DNA, 23 bp, Homo sapiens
cgtgattccagtggtacaagtcg

SEQ ID NO: 16399 - DNA, 25 bp, Homo sapiens
gaacaagatcctaccaacctctaca

SEQ ID NO: 16400 - DNA, 25 bp, Homo sapiens
caggacctggtgaagctctgtcaac

SEQ ID NO: 16401 - DNA, 24 bp, Homo sapiens
ctttgacaatcgtgcccccaacac

SEQ ID NO: 16402 - DNA, 24 bp, Homo sapiens
tctttgacaatcgtgcccccaaca

SEQ ID NO: 16403 - DNA, 24 bp, Homo sapiens
atctttgacaatcgtgcccccaac

SEQ ID NO: 16404 - DNA, 24 bp, Homo sapiens
ggactacgacctgaatgctgtgcg

SEQ ID NO: 16405 - DNA, 24 bp, Homo sapiens
cctgccgcctgtccttcctcatcc

SEQ ID NO: 16406 - DNA, 24 bp, Homo sapiens
ggtgtatttcacgggaccaggctg

SEQ ID NO: 16407 - DNA, 24 bp, Homo sapiens
acggcggctgggatacttttgtgg

SEQ ID NO: 16408 - DNA, 24 bp, Homo sapiens
aacggcggctgggatacttttgtg

SEQ ID NO: 16409 - DNA, 24 bp, Homo sapiens
gaacggcggctgggatacttttgt

SEQ ID NO: 16410 - DNA, 23 bp, Homo sapiens
aggaggctggcaggtatggaagg

SEQ ID NO: 16411 - DNA, 23 bp, Homo sapiens
cctcctcacctctggactggcta

SEQ ID NO: 16412 - DNA, 25 bp, Homo sapiens
cccagtccaaatgtcctccagaagc

SEQ ID NO: 16413 - DNA, 24 bp, Homo sapiens
cacctgcccatcacagggttgggc

SEQ ID NO: 16414 - DNA, 24 bp, Homo sapiens
ccacctgcccatcacagggttggg

SEQ ID NO: 16415 - DNA, 24 bp, Homo sapiens
cccacctgcccatcacagggttgg

SEQ ID NO: 16416 - DNA, 25 bp, Homo sapiens
acctgaatgaccacctagagccttg

SEQ ID NO: 16417 - DNA, 24 bp, Homo sapiens
gcaggtattggtgagtcggatcgc

SEQ ID NO: 16418 - DNA, 25 bp, Homo sapiens
aacaggtagtgaatgaactcttccg

SEQ ID NO: 16419 - DNA, 23 bp, Homo sapiens
ggaacaatgcagcagccgagagc

SEQ ID NO: 16420 - DNA, 25 bp, Homo sapiens
tgaccagacactgaccatccactct

SEQ ID NO: 16421 - DNA, 23 bp, Homo sapiens
tctctgctccaccacatcctccg

SEQ ID NO: 16422 - DNA, 23 bp, Homo sapiens
ggaacaatgcagcagccgagagc

SEQ ID NO: 16423 - DNA, 23 bp, Homo sapiens
aggaacgcttcaaccgctggttc

SEQ ID NO: 16424 - DNA, 23 bp, Homo sapiens
gctcactcttcagtcggaaatga

SEQ ID NO: 16425 - DNA, 24 bp, Homo sapiens
gcactctgaggttctgtctcctga

SEQ ID NO: 16426 - DNA, 24 bp, Homo sapiens
atcccaggagttctctgctgagtt

SEQ ID NO: 16427 - DNA, 24 bp, Homo sapiens
ccagccaatatggtagaagttcac

SEQ ID NO: 16428 - DNA, 24 bp, Homo sapiens
ggctctggtacatcttcttgctgg

SEQ ID NO: 16429 - DNA, 24 bp, Homo sapiens
gatgccatcaccatgtcgctcctt

SEQ ID NO: 16430 - DNA, 24 bp, Homo sapiens
gcagaaatacccacagaagttcaa

SEQ ID NO: 16431 - DNA, 24 bp, Homo sapiens
gcaagtagttctggaggctctcaa

SEQ ID NO: 16432 - DNA, 24 bp, Homo sapiens
ccctttctgcttccctacccactg

SEQ ID NO: 16433 - DNA, 24 bp, Homo sapiens
gtctggtgctgaggttaagtttgt

SEQ ID NO: 16434 - DNA, 22 bp, Homo sapiens
tgaaggcttttggtctccctgg

SEQ ID NO: 16435 - DNA, 22 bp, Homo sapiens
ggtggaggcagccagggcttac

SEQ ID NO: 16436 - DNA, 23 bp, Homo sapiens
cagcctcagccttgcccttctgc

SEQ ID NO: 16437 - DNA, 24 bp, Homo sapiens
acccacagtccaaacaagcctcag

SEQ ID NO: 16438 - DNA, 24 bp, Homo sapiens
tgggtgctgatggactgatttgct

SEQ ID NO: 16439 - DNA, 24 bp, Homo sapiens
ttggcaaatcacaacattctgggc

SEQ ID NO: 16440 - DNA, 24 bp, Homo sapiens
tgtggtaaagaagggaagcatctc

SEQ ID NO: 16441 - DNA, 24 bp, Homo sapiens
cctcattcatcgtctcttccatcc

SEQ ID NO: 16442 - DNA, 24 bp, Homo sapiens
gggactgtctgagtgacctgctgg

SEQ ID NO: 16443 - DNA, 24 bp, Homo sapiens
gactctcagcaacaacaccagagc

SEQ ID NO: 16444 - DNA, 24 bp, Homo sapiens
cctcctgggagtcttgagcctaag

SEQ ID NO: 16445 - DNA, 24 bp, Homo sapiens
agcggaaagcagatactaccaccc

SEQ ID NO: 16446 - DNA, 24 bp, Homo sapiens
ggggccaggaggtaaaacttcctt

SEQ ID NO: 16447 - DNA, 24 bp, Homo sapiens
aggggccaggaggtaaaacttcct

SEQ ID NO: 16448 - DNA, 24 bp, Homo sapiens
caggggccaggaggtaaaacttcc

SEQ ID NO: 16449 - DNA, 24 bp, Homo sapiens
tcatctctcccttcgcccagttcc

SEQ ID NO: 16450 - DNA, 23 bp, Homo sapiens
cctaagactcgaaggcagcacag

SEQ ID NO: 16451 - DNA, 25 bp, Homo sapiens
gtcacaaggttgccccacaaaactt

SEQ ID NO: 16452 - DNA, 24 bp, Homo sapiens
acaggcctcaggccctcaggtact

SEQ ID NO: 16453 - DNA, 24 bp, Homo sapiens
tacaggcctcaggccctcaggtac

SEQ ID NO: 16454 - DNA, 24 bp, Homo sapiens
ctacaggcctcaggccctcaggta

SEQ ID NO: 16455 - DNA, 24 bp, Homo sapiens
gcaagccagatgagtaaccagagg

SEQ ID NO: 16456 - DNA, 24 bp, Homo sapiens
agagcctgtggtggttgatctgac

SEQ ID NO: 16457 - DNA, 24 bp, Homo sapiens
tgactctgttgtgattgttgacga

SEQ ID NO: 16458 - DNA, 24 bp, Homo sapiens
ggcacctcttatctctgttcacct

SEQ ID NO: 16459 - DNA, 24 bp, Homo sapiens
caacttatggaaacaactacagaa

SEQ ID NO: 16460 - DNA, 24 bp, Homo sapiens
aaaaggatactcaaaccaaaagta

SEQ ID NO: 16461 - DNA, 24 bp, Homo sapiens
agagaccagtaataaaattgacgc

SEQ ID NO: 16462 - DNA, 25 bp, Homo sapiens
ttctggacttcatcctccgacctga

SEQ ID NO: 16463 - DNA, 23 bp, Homo sapiens
tgctgacgatcacttcctgccat

SEQ ID NO: 16464 - DNA, 25 bp, Homo sapiens
tgctattctctggatggacttcgtg

SEQ ID NO: 16465 - DNA, 24 bp, Homo sapiens
caacacaccagcttttatttgtta

SEQ ID NO: 16466 - DNA, 24 bp, Homo sapiens
acaacacaccagcttttatttgtt

SEQ ID NO: 16467 - DNA, 24 bp, Homo sapiens
aacaacacaccagcttttatttgt

SEQ ID NO: 16468 - DNA, 24 bp, Homo sapiens
gcaagcacaatgatcatatccaga

SEQ ID NO: 16469 - DNA, 24 bp, Homo sapiens
ggcaagcacaatgatcatatccag

SEQ ID NO: 16470 - DNA, 24 bp, Homo sapiens
aggcaagcacaatgatcatatcca

SEQ ID NO: 16471 - DNA, 24 bp, Homo sapiens
agatcagtaatcttaaggctgcct

SEQ ID NO: 16472 - DNA, 24 bp, Homo sapiens
acaaagcagaggtgagtgaaggca

SEQ ID NO: 16473 - DNA, 24 bp, Homo sapiens
gacaaagcagaggtgagtgaaggc

SEQ ID NO: 16474 - DNA, 24 bp, Homo sapiens
agacaaagcagaggtgagtgaagg

SEQ ID NO: 16475 - DNA, 25 bp, Homo sapiens
aaggagcagaaagaaccaatgatga

SEQ ID NO: 16476 - DNA, 25 bp, Homo sapiens
aagtgttcctacaggttatcacagt

SEQ ID NO: 16477 - DNA, 25 bp, Homo sapiens
tggaaagcaagaagaaaactgtggg

SEQ ID NO: 16478 - DNA, 24 bp, Homo sapiens
caaagtgctgggattacaggcgtg

SEQ ID NO: 16479 - DNA, 24 bp, Homo sapiens
ctcctgacctcaggtgattcacct

SEQ ID NO: 16480 - DNA, 24 bp, Homo sapiens
tggccatgaatcctgtggagcatc

SEQ ID NO: 16481 - DNA, 24 bp, Homo sapiens
gtggccatgaatcctgtggagcat

SEQ ID NO: 16482 - DNA, 24 bp, Homo sapiens
tgtggccatgaatcctgtggagca

SEQ ID NO: 16483 - DNA, 23 bp, Homo sapiens
tgtggttggtgtggtggctggag

SEQ ID NO: 16484 - DNA, 25 bp, Homo sapiens
cgggcgtaccacaaatataaggcaa

SEQ ID NO: 16485 - DNA, 25 bp, Homo sapiens
gccatgaatcctgtggagcatcctt

SEQ ID NO: 16486 - DNA, 24 bp, Homo sapiens
atgccaccgttatctcccacaacc

SEQ ID NO: 16487 - DNA, 24 bp, Homo sapiens
tatgccaccgttatctcccacaac

SEQ ID NO: 16488 - DNA, 24 bp, Homo sapiens
ctatgccaccgttatctcccacaa

SEQ ID NO: 16489 - DNA, 24 bp, Homo sapiens
actatgccaccgttatctcccaca

SEQ ID NO: 16490 - DNA, 24 bp, Homo sapiens
aactatgccaccgttatctcccac

SEQ ID NO: 16491 - DNA, 24 bp, Homo sapiens
gaactatgccaccgttatctccca

SEQ ID NO: 16492 - DNA, 24 bp, Homo sapiens
agaagaaaaagatatcccagaaga

SEQ ID NO: 16493 - DNA, 24 bp, Homo sapiens
cagaagaaaaagatatcccagaag

SEQ ID NO: 16494 - DNA, 24 bp, Homo sapiens
ccagaagaaaaagatatcccagaa

SEQ ID NO: 16495 - DNA, 24 bp, Homo sapiens
gggaccataactgatgatgtgcgg

SEQ ID NO: 16496 - DNA, 24 bp, Homo sapiens
gccagaagaaccaactccacattc

SEQ ID NO: 16497 - DNA, 24 bp, Homo sapiens
tgaggctgttggtcaagttataca

SEQ ID NO: 16498 - DNA, 24 bp, Homo sapiens
tatctacctgaggctgttggtcaa

SEQ ID NO: 16499 - DNA, 24 bp, Homo sapiens
aaaggttcggcgcaaggagcccaa

SEQ ID NO: 16500 - DNA, 24 bp, Homo sapiens
gcaaggagcccaagagccaggata

SEQ ID NO: 16501 - DNA, 24 bp, Homo sapiens
ccaggttgtgttgaagaggttgtt

SEQ ID NO: 16502 - DNA, 24 bp, Homo sapiens
gggaccataactgatgatgtgcgg

SEQ ID NO: 16503 - DNA, 24 bp, Homo sapiens
gggcaagatcctcactttcgacca

SEQ ID NO: 16504 - DNA, 24 bp, Homo sapiens
ctacctgaggctgttggtcaagtt

SEQ ID NO: 16505 - DNA, 24 bp, Homo sapiens
ggacatccgccataacaaggaccg

SEQ ID NO: 16506 - DNA, 24 bp, Homo sapiens
tcggcgcaaggagcccaagagcca

SEQ ID NO: 16507 - DNA, 24 bp, Homo sapiens
gcaagatcctcactttcgaccagc

SEQ ID NO: 16508 - DNA, 24 bp, Homo sapiens
gggcccgcagccgcatcctcaggg

SEQ ID NO: 16509 - DNA, 24 bp, Homo sapiens
gcaaggagcccaagagccaggata

SEQ ID NO: 16510 - DNA, 24 bp, Homo sapiens
ggacatccgccataacaaggaccg

SEQ ID NO: 16511 - DNA, 24 bp, Homo sapiens
gaaccaactccacattcaaccagg

SEQ ID NO: 16512 - DNA, 24 bp, Homo sapiens
tgaagaggttgtttatgagtcgca

SEQ ID NO: 16513 - DNA, 24 bp, Homo sapiens
tcaagcagttccacgactccaaga

SEQ ID NO: 16514 - DNA, 24 bp, Homo sapiens
cccgagcccactccattcagatca

SEQ ID NO: 16515 - DNA, 24 bp, Homo sapiens
gctgtcacccagtgctaccgagac

SEQ ID NO: 16516 - DNA, 24 bp, Homo sapiens
acgcgccccaggtgggcagctgtg

SEQ ID NO: 16517 - DNA, 24 bp, Homo sapiens
gacgcgccccaggtgggcagctgt

SEQ ID NO: 16518 - DNA, 24 bp, Homo sapiens
ggacgcgccccaggtgggcagctg

SEQ ID NO: 16519 - DNA, 25 bp, Homo sapiens
tcaagtgattctcctgcctcagcct

SEQ ID NO: 16520 - DNA, 23 bp, Homo sapiens
tagctgggattataggcatgtgc

SEQ ID NO: 16521 - DNA, 23 bp, Homo sapiens
gatctcggctcaccgcaccctct

SEQ ID NO: 16522 - DNA, 24 bp, Homo sapiens
agaagagaaagggccaagtgatcc

SEQ ID NO: 16523 - DNA, 24 bp, Homo sapiens
aagaagagaaagggccaagtgatc

SEQ ID NO: 16524 - DNA, 24 bp, Homo sapiens
taagaagagaaagggccaagtgat

SEQ ID NO: 16525 - DNA, 24 bp, Homo sapiens
ggctcaacaaggttatcagtgagc

SEQ ID NO: 16526 - DNA, 24 bp, Homo sapiens
cggctcaacaaggttatcagtgag

SEQ ID NO: 16527 - DNA, 24 bp, Homo sapiens
ccggctcaacaaggttatcagtga

SEQ ID NO: 16528 - DNA, 24 bp, Homo sapiens
agaagaaggaggagtctgaagagt

SEQ ID NO: 16529 - DNA, 24 bp, Homo sapiens
cctgctcccctgcaaataaagcct

SEQ ID NO: 16530 - DNA, 24 bp, Homo sapiens
tgacatgggatttggcctttttga

SEQ ID NO: 16531 - DNA, 24 bp, Homo sapiens
gaccttccgcaagttcacctaccg

SEQ ID NO: 16532 - DNA, 24 bp, Homo sapiens
gacctcgaccagctgctggacatg

SEQ ID NO: 16533 - DNA, 24 bp, Homo sapiens
agagcagaagaagaagcggacctt

SEQ ID NO: 16534 - DNA, 24 bp, Homo sapiens
ttcacctaccgcggcgtggacctc

SEQ ID NO: 16535 - DNA, 24 bp, Homo sapiens
acctgcgggacatgatcatcctac

SEQ ID NO: 16536 - DNA, 24 bp, Homo sapiens
cacctgcgggacatgatcatccta

SEQ ID NO: 16537 - DNA, 24 bp, Homo sapiens
gcacctgcgggacatgatcatcct

SEQ ID NO: 16538 - DNA, 24 bp, Homo sapiens
cccatggagaagccggaagtggtg

SEQ ID NO: 16539 - DNA, 24 bp, Homo sapiens
gcactccctgctgaagcgcctgcg

SEQ ID NO: 16540 - DNA, 24 bp, Homo sapiens
acatgtcctacgagcagctgatgc

SEQ ID NO: 16541 - DNA, 24 bp, Homo sapiens
ggcagcatggtgggcgtctacaac

SEQ ID NO: 16542 - DNA, 24 bp, Homo sapiens
gagaagccggaagtggtgaagacg

SEQ ID NO: 16543 - DNA, 24 bp, Homo sapiens
gcactccctgctgaagcgcctgcg

SEQ ID NO: 16544 - DNA, 24 bp, Homo sapiens
caggagttgaggtggaagtcacca

SEQ ID NO: 16545 - DNA, 24 bp, Homo sapiens
ccaggagttgaggtggaagtcacc

SEQ ID NO: 16546 - DNA, 24 bp, Homo sapiens
gccaggagttgaggtggaagtcac

SEQ ID NO: 16547 - DNA, 24 bp, Homo sapiens
ctggcaaaaagtgagctggagatt

SEQ ID NO: 16548 - DNA, 24 bp, Homo sapiens
gctggcaaaaagtgagctggagat

SEQ ID NO: 16549 - DNA, 24 bp, Homo sapiens
tgctggcaaaaagtgagctggaga

SEQ ID NO: 16550 - DNA, 24 bp, Homo sapiens
ctggcaaaaagccgaaggagtaaa

SEQ ID NO: 16551 - DNA, 24 bp, Homo sapiens
gctggcaaaaagccgaaggagtaa

SEQ ID NO: 16552 - DNA, 24 bp, Homo sapiens
tgctggcaaaaagccgaaggagta

SEQ ID NO: 16553 - DNA, 23 bp, Homo sapiens
ccgtgttgctcaggctgctcttg

SEQ ID NO: 16554 - DNA, 24 bp, Homo sapiens
gattctcccacctcagcctccctt

SEQ ID NO: 16555 - DNA, 23 bp, Homo sapiens
cacaagcacttggttagaatggc

SEQ ID NO: 16556 - DNA, 25 bp, Homo sapiens
gtgctgcaatgatgttagctgtggc

SEQ ID NO: 16557 - DNA, 25 bp, Homo sapiens
ttcgcaagaacattaataaactaaa

SEQ ID NO: 16558 - DNA, 24 bp, Homo sapiens
tgcatgaataggtccaaccagctg

SEQ ID NO: 16559 - DNA, 24 bp, Homo sapiens
atgcatgaataggtccaaccagct

SEQ ID NO: 16560 - DNA, 24 bp, Homo sapiens
gatgcatgaataggtccaaccagc

SEQ ID NO: 16561 - DNA, 24 bp, Homo sapiens
cctgcccggccgttgctccgactg

SEQ ID NO: 16562 - DNA, 24 bp, Homo sapiens
tcctgcccggccgttgctccgact

SEQ ID NO: 16563 - DNA, 24 bp, Homo sapiens
gtcctgcccggccgttgctccgac

SEQ ID NO: 16564 - DNA, 24 bp, Homo sapiens
tggtctttaagttggacacactta

SEQ ID NO: 16565 - DNA, 24 bp, Homo sapiens
ttggtctttaagttggacacactt

SEQ ID NO: 16566 - DNA, 24 bp, Homo sapiens
cttggtctttaagttggacacact

SEQ ID NO: 16567 - DNA, 24 bp, Homo sapiens
cagctcctcaggtaatacagacac

SEQ ID NO: 16568 - DNA, 24 bp, Homo sapiens
gcagctcctcaggtaatacagaca

SEQ ID NO: 16569 - DNA, 24 bp, Homo sapiens
agcagctcctcaggtaatacagac

SEQ ID NO: 16570 - DNA, 25 bp, Homo sapiens
aagcagaagaccagcatctcgtaga

SEQ ID NO: 16571 - DNA, 24 bp, Homo sapiens
aacagtctggaagccatcaggtcg

SEQ ID NO: 16572 - DNA, 23 bp, Homo sapiens
caacaagactctgaacgggctgc

SEQ ID NO: 16573 - DNA, 25 bp, Homo sapiens
gcagggacgaagtcacaagtcatca

SEQ ID NO: 16574 - DNA, 24 bp, Homo sapiens
agaaaccctaaagcaggcagcagc

SEQ ID NO: 16575 - DNA, 25 bp, Homo sapiens
ggaagaagaaagatctgtgctcaat

SEQ ID NO: 16576 - DNA, 24 bp, Homo sapiens
aatatggcttgttcgctcctgtcc

SEQ ID NO: 16577 - DNA, 25 bp, Homo sapiens
ttccactacaccagccaaagccaag

SEQ ID NO: 16578 - DNA, 23 bp, Homo sapiens
cagtgaggcgagtgatggcgacc

SEQ ID NO: 16579 - DNA, 25 bp, Homo sapiens
ggaacagatgaccaaagagaagact

SEQ ID NO: 16580 - DNA, 23 bp, Homo sapiens
ggaggacaccaagcaaacaaatg

SEQ ID NO: 16581 - DNA, 25 bp, Homo sapiens
tagaaaccctaaagcaggcagcagc

SEQ ID NO: 16582 - DNA, 25 bp, Homo sapiens
aagaactcctgactgtagagaatca

SEQ ID NO: 16583 - DNA, 25 bp, Homo sapiens
tagaaaccctaaagcaggcagcagc

SEQ ID NO: 16584 - DNA, 25 bp, Homo sapiens
ggagaagcagggacgaagtcacaag

SEQ ID NO: 16585 - DNA, 25 bp, Homo sapiens
ggagaagcagggacgaagtcacaag

SEQ ID NO: 16586 - DNA, 25 bp, Homo sapiens
gctggagaaactgagaaatgaggtc

SEQ ID NO: 16587 - DNA, 23 bp, Homo sapiens
aaacgcctctgccaagtccttgc

SEQ ID NO: 16588 - DNA, 25 bp, Homo sapiens
ggtaatacagacactcaggcagacg

SEQ ID NO: 16589 - DNA, 25 bp, Homo sapiens
ggtggagatgatgtcagaagcagcc

SEQ ID NO: 16590 - DNA, 23 bp, Homo sapiens
aacctcgcctcttctgtgacatt

SEQ ID NO: 16591 - DNA, 23 bp, Homo sapiens
aacctcgcctcttctgtgacatt

SEQ ID NO: 16592 - DNA, 23 bp, Homo sapiens
ccaggcacagatgtcagaggacc

SEQ ID NO: 16593 - DNA, 25 bp, Homo sapiens
ggtgaggaacgcccatactgtgaaa

SEQ ID NO: 16594 - DNA, 24 bp, Homo sapiens
ctgcctcccagggtccctgcaccg

SEQ ID NO: 16595 - DNA, 24 bp, Homo sapiens
tctgcctcccagggtccctgcacc

SEQ ID NO: 16596 - DNA, 24 bp, Homo sapiens
ctctgcctcccagggtccctgcac

SEQ ID NO: 16597 - DNA, 24 bp, Homo sapiens
cagaagacctggtggggcaagtcc

SEQ ID NO: 16598 - DNA, 24 bp, Homo sapiens
tcagaagacctggtggggcaagtc

SEQ ID NO: 16599 - DNA, 24 bp, Homo sapiens
ttcagaagacctggtggggcaagt

SEQ ID NO: 16600 - DNA, 24 bp, Homo sapiens
agtatatcaggaaaaagggtgcag

SEQ ID NO: 16601 - DNA, 24 bp, Homo sapiens
cagtatatcaggaaaaagggtgca

SEQ ID NO: 16602 - DNA, 24 bp, Homo sapiens
tcagtatatcaggaaaaagggtgc

SEQ ID NO: 16603 - DNA, 24 bp, Homo sapiens
gccatgaagaaagccacaaagagt

SEQ ID NO: 16604 - DNA, 24 bp, Homo sapiens
ttaacttccaggagttcctcattc

SEQ ID NO: 16605 - DNA, 24 bp, Homo sapiens
cctggacatgtacctgcagaataa

SEQ ID NO: 16606 - DNA, 24 bp, Homo sapiens
catcatgttgaccgagctggagaa

SEQ ID NO: 16607 - DNA, 24 bp, Homo sapiens
ccatgccgtctacagggatgacct

SEQ ID NO: 16608 - DNA, 24 bp, Homo sapiens
tgctagagaccgagtgtcctcagt

SEQ ID NO: 16609 - DNA, 24 bp, Homo sapiens
atgtctcttgtcagctgtctttca

SEQ ID NO: 16610 - DNA, 24 bp, Homo sapiens
gtctcttgtcagctgtctttcaga

SEQ ID NO: 16611 - DNA, 24 bp, Homo sapiens
tggatatcaacactgatggtgcag

SEQ ID NO: 16612 - DNA, 24 bp, Homo sapiens
ctggtgataaagatgggcgtggca

SEQ ID NO: 16613 - DNA, 24 bp, Homo sapiens
atgaagaaagccacaaagagtagc

SEQ ID NO: 16614 - DNA, 24 bp, Homo sapiens
acacatcatggaggacctggacac

SEQ ID NO: 16615 - DNA, 24 bp, Homo sapiens
atgctgatggcgaggctaacctgg

SEQ ID NO: 16616 - DNA, 24 bp, Homo sapiens
cacgagaagatgcacgagggtgac

SEQ ID NO: 16617 - DNA, 24 bp, Homo sapiens
ggcctgggcaggtgggtgtcggca

SEQ ID NO: 16618 - DNA, 24 bp, Homo sapiens
cggcctgggcaggtgggtgtcggc

SEQ ID NO: 16619 - DNA, 24 bp, Homo sapiens
ccggcctgggcaggtgggtgtcgg

SEQ ID NO: 16620 - DNA, 24 bp, Homo sapiens
atgattttaggttacagccaagtt

SEQ ID NO: 16621 - DNA, 24 bp, Homo sapiens
aatgattttaggttacagccaagt

SEQ ID NO: 16622 - DNA, 24 bp, Homo sapiens
gaatgattttaggttacagccaag

SEQ ID NO: 16623 - DNA, 24 bp, Homo sapiens
atcagtctcagcatcctcatgtct

SEQ ID NO: 16624 - DNA, 24 bp, Homo sapiens
tatcagtctcagcatcctcatgtc

SEQ ID NO: 16625 - DNA, 24 bp, Homo sapiens
ttatcagtctcagcatcctcatgt

SEQ ID NO: 16626 - DNA, 24 bp, Homo sapiens
gtcctgttcagcaccatcagcacc

SEQ ID NO: 16627 - DNA, 24 bp, Homo sapiens
agtcctgttcagcaccatcagcac

SEQ ID NO: 16628 - DNA, 24 bp, Homo sapiens
cagtcctgttcagcaccatcagca

SEQ ID NO: 16629 - DNA, 24 bp, Homo sapiens
cggcaagaccagcatcatcagagt

SEQ ID NO: 16630 - DNA, 24 bp, Homo sapiens
cctcagcagttcccaaatcagccc

SEQ ID NO: 16631 - DNA, 24 bp, Homo sapiens
gccacattatcagtctcagcatcc

SEQ ID NO: 16632 - DNA, 24 bp, Homo sapiens
gccacattatcagtctcagcatcc

SEQ ID NO: 16633 - DNA, 24 bp, Homo sapiens
cggcaagaccagcatcatcagagt

SEQ ID NO: 16634 - DNA, 24 bp, Homo sapiens
atgccagtgaatcaagccaagaca

SEQ ID NO: 16635 - DNA, 24 bp, Homo sapiens
cggcaagaccagcatcatcagagt

SEQ ID NO: 16636 - DNA, 24 bp, Homo sapiens
atgcacccagcgtcagcagcgggc

SEQ ID NO: 16637 - DNA, 24 bp, Homo sapiens
ccaccagcttactccacgcaatat

SEQ ID NO: 16638 - DNA, 24 bp, Homo sapiens
ccagtgaagcagctactcctccag

SEQ ID NO: 16639 - DNA, 24 bp, Homo sapiens
tccagctcctgtctctactatgcc

SEQ ID NO: 16640 - DNA, 24 bp, Homo sapiens
ccaactctcttccacctcgggcag

SEQ ID NO: 16641 - DNA, 24 bp, Homo sapiens
ggtcagtggggctgcatctcctac

SEQ ID NO: 16642 - DNA, 24 bp, Homo sapiens
tggtcagtggggctgcatctccta

SEQ ID NO: 16643 - DNA, 24 bp, Homo sapiens
gtggtcagtggggctgcatctcct

SEQ ID NO: 16644 - DNA, 24 bp, Homo sapiens
atctccttcctctcgcccaccttc

SEQ ID NO: 16645 - DNA, 24 bp, Homo sapiens
ccaactctcttccacctcgggcag

SEQ ID NO: 16646 - DNA, 24 bp, Homo sapiens
tccagctcctgtctctactatgcc

SEQ ID NO: 16647 - DNA, 24 bp, Homo sapiens
atggcgaacacaaagagaaggacc

SEQ ID NO: 16648 - DNA, 24 bp, Homo sapiens
tcacagccaatgaggaacttgagg

SEQ ID NO: 16649 - DNA, 24 bp, Homo sapiens
atgacgtatctaatggatgggatc

SEQ ID NO: 16650 - DNA, 24 bp, Homo sapiens
atggcgaacacaaagagaaggacc

SEQ ID NO: 16651 - DNA, 24 bp, Homo sapiens
tcacagccaatgaggaacttgagg

SEQ ID NO: 16652 - DNA, 24 bp, Homo sapiens
aaacgggaagcaagggcaaaccag

SEQ ID NO: 16653 - DNA, 24 bp, Homo sapiens
gctccatgccatcaagatccactt

SEQ ID NO: 16654 - DNA, 24 bp, Homo sapiens
atctccttcctctcgcccaccttc

SEQ ID NO: 16655 - DNA, 24 bp, Homo sapiens
ccaactctcttccacctcgggcag

SEQ ID NO: 16656 - DNA, 24 bp, Homo sapiens
tgccagtgaatcaagccaagacat

SEQ ID NO: 16657 - DNA, 24 bp, Homo sapiens
cggcaagaccagcatcatcagagt

SEQ ID NO: 16658 - DNA, 24 bp, Homo sapiens
gccacattatcagtctcagcatcc

SEQ ID NO: 16659 - DNA, 24 bp, Homo sapiens
gccgttcctcccacttcagtattt

SEQ ID NO: 16660 - DNA, 24 bp, Homo sapiens
cgcatcctcatcaagttccaagtt

SEQ ID NO: 16661 - DNA, 24 bp, Homo sapiens
cccattcagcaaagtagagttccc

SEQ ID NO: 16662 - DNA, 24 bp, Homo sapiens
ccagcagtcgtctttgtcacccga

SEQ ID NO: 16663 - DNA, 24 bp, Homo sapiens
cccagcagtcgtctttgtcacccg

SEQ ID NO: 16664 - DNA, 24 bp, Homo sapiens
acccagcagtcgtctttgtcaccc

SEQ ID NO: 16665 - DNA, 24 bp, Homo sapiens
ccaagtgtgtgccaacccagagaa

SEQ ID NO: 16666 - DNA, 24 bp, Homo sapiens
gcctgtttctgcttgctcttgtcc

SEQ ID NO: 16667 - DNA, 24 bp, Homo sapiens
gcccagattctaccacacagcagc

SEQ ID NO: 16668 - DNA, 23 bp, Homo sapiens
ggcgagcggttccttgtgggcta

SEQ ID NO: 16669 - DNA, 24 bp, Homo sapiens
cctctgggcaggttcatcaatgcc

SEQ ID NO: 16670 - DNA, 24 bp, Homo sapiens
acctctgggcaggttcatcaatgc

SEQ ID NO: 16671 - DNA, 24 bp, Homo sapiens
tacctctgggcaggttcatcaatg

SEQ ID NO: 16672 - DNA, 24 bp, Homo sapiens
tcacccgaacagtcctccatgtga

SEQ ID NO: 16673 - DNA, 24 bp, Homo sapiens
atcacccgaacagtcctccatgtg

SEQ ID NO: 16674 - DNA, 24 bp, Homo sapiens
gatcacccgaacagtcctccatgt

SEQ ID NO: 16675 - DNA, 24 bp, Homo sapiens
ggctctggaggagccctgcccttc

SEQ ID NO: 16676 - DNA, 24 bp, Homo sapiens
cggctctggaggagccctgccctt

SEQ ID NO: 16677 - DNA, 24 bp, Homo sapiens
gcggctctggaggagccctgccct

SEQ ID NO: 16678 - DNA, 24 bp, Homo sapiens
ccgcctcccgagtttacaccattc

SEQ ID NO: 16679 - DNA, 23 bp, Homo sapiens
gagtgtggcgcgatctcagctca

SEQ ID NO: 16680 - DNA, 23 bp, Homo sapiens
cagcctcccaagtagctgggact

SEQ ID NO: 16681 - DNA, 23 bp, Homo sapiens
ctgcctcggcctcctgagtggct

SEQ ID NO: 16682 - DNA, 24 bp, Homo sapiens
accctcttcagggtcattcccgta

SEQ ID NO: 16683 - DNA, 24 bp, Homo sapiens
caccctcttcagggtcattcccgt

SEQ ID NO: 16684 - DNA, 24 bp, Homo sapiens
ccaccctcttcagggtcattcccg

SEQ ID NO: 16685 - DNA, 24 bp, Homo sapiens
acagttaccaggtaagacaagcag

SEQ ID NO: 16686 - DNA, 24 bp, Homo sapiens
gacagttaccaggtaagacaagca

SEQ ID NO: 16687 - DNA, 24 bp, Homo sapiens
ggacagttaccaggtaagacaagc

SEQ ID NO: 16688 - DNA, 24 bp, Homo sapiens
tgcagtctgggaattccggggaga

SEQ ID NO: 16689 - DNA, 24 bp, Homo sapiens
ctgcagtctgggaattccggggag

SEQ ID NO: 16690 - DNA, 24 bp, Homo sapiens
cctgcagtctgggaattccgggga

SEQ ID NO: 16691 - DNA, 25 bp, Homo sapiens
aaccatgctgttgtgaatgaggacc

SEQ ID NO: 16692 - DNA, 25 bp, Homo sapiens
agccgcagacaactatgaagagacc

SEQ ID NO: 16693 - DNA, 25 bp, Homo sapiens
cgagattcagtcctcacttggctgc

SEQ ID NO: 16694 - DNA, 25 bp, Homo sapiens
ttgacattgcatctgatggagacgt

SEQ ID NO: 16695 - DNA, 24 bp, Homo sapiens
cctgctcttaacgaacttctggtt

SEQ ID NO: 16696 - DNA, 25 bp, Homo sapiens
gacaacgacaacttgaaagcatggg

SEQ ID NO: 16697 - DNA, 24 bp, Homo sapiens
cctggcgggtagcgaaagagtatc

SEQ ID NO: 16698 - DNA, 23 bp, Homo sapiens
gggagaaagtcagtaaggtcagc

SEQ ID NO: 16699 - DNA, 25 bp, Homo sapiens
cgctcccatgctgtgttcaacatca

SEQ ID NO: 16700 - DNA, 25 bp, Homo sapiens
agccaaacctctatgatagccacaa

SEQ ID NO: 16701 - DNA, 25 bp, Homo sapiens
agccgcagacaactatgaagagacc

SEQ ID NO: 16702 - DNA, 25 bp, Homo sapiens
aaccatgctgttgtgaatgaggacc

SEQ ID NO: 16703 - DNA, 25 bp, Homo sapiens
ggttggttatatcatcactggctga

SEQ ID NO: 16704 - DNA, 23 bp, Homo sapiens
aggagagcgactgaaagaaggca

SEQ ID NO: 16705 - DNA, 24 bp, Homo sapiens
cctggcgggtagcgaaagagtatc

SEQ ID NO: 16706 - DNA, 25 bp, Homo sapiens
ttgacattgcatctgatggagacgt

SEQ ID NO: 16707 - DNA, 25 bp, Homo sapiens
gcagatacctctcaagatatccagc

SEQ ID NO: 16708 - DNA, 24 bp, Homo sapiens
gcataggaattcagcctcagcact

SEQ ID NO: 16709 - DNA, 23 bp, Homo sapiens
gctgtggcatggtgaccgaatcc

SEQ ID NO: 16710 - DNA, 23 bp, Homo sapiens
ctgtgtgaacggcacccttgtgt

SEQ ID NO: 16711 - DNA, 24 bp, Homo sapiens
cctgctcttaacgaacttctggtt

SEQ ID NO: 16712 - DNA, 25 bp, Homo sapiens
tgaggaggaaaggaaagagcaccca

SEQ ID NO: 16713 - DNA, 25 bp, Homo sapiens
ttggaatgcctcttctgtgatgtga

SEQ ID NO: 16714 - DNA, 25 bp, Homo sapiens
tggaagtgatgcgtgttacaggagc

SEQ ID NO: 16715 - DNA, 24 bp, Homo sapiens
atcattttcaggttggtcttggac

SEQ ID NO: 16716 - DNA, 24 bp, Homo sapiens
gatcattttcaggttggtcttgga

SEQ ID NO: 16717 - DNA, 24 bp, Homo sapiens
tgatcattttcaggttggtcttgg

SEQ ID NO: 16718 - DNA, 24 bp, Homo sapiens
acggaaaccagctttgaccgccat

SEQ ID NO: 16719 - DNA, 24 bp, Homo sapiens
tacggaaaccagctttgaccgcca

SEQ ID NO: 16720 - DNA, 24 bp, Homo sapiens
gtacggaaaccagctttgaccgcc

SEQ ID NO: 16721 - DNA, 24 bp, Homo sapiens
ccacagaatatccaggcagcgaga

SEQ ID NO: 16722 - DNA, 24 bp, Homo sapiens
aggcagcaagcatgaaccatacca

SEQ ID NO: 16723 - DNA, 24 bp, Homo sapiens
aagaagaggctgctaagagacggc

SEQ ID NO: 16724 - DNA, 24 bp, Homo sapiens
ggcgtggagtagaacagaatcatc

SEQ ID NO: 16725 - DNA, 24 bp, Homo sapiens
ttcggaaggaagtgacattgtacc

SEQ ID NO: 16726 - DNA, 24 bp, Homo sapiens
ttggacagagtgggcttggaatgg

SEQ ID NO: 16727 - DNA, 24 bp, Homo sapiens
cagtacctcctcctggctgaacag

SEQ ID NO: 16728 - DNA, 24 bp, Homo sapiens
gagaagcaagcattgtaggtgaga

SEQ ID NO: 16729 - DNA, 24 bp, Homo sapiens
ctctcaaggctatactgtggctag

SEQ ID NO: 16730 - DNA, 24 bp, Homo sapiens
ccgagtctccacagcgcgacccgc

SEQ ID NO: 16731 - DNA, 24 bp, Homo sapiens
tccgagtctccacagcgcgacccg

SEQ ID NO: 16732 - DNA, 24 bp, Homo sapiens
ctccgagtctccacagcgcgaccc

SEQ ID NO: 16733 - DNA, 24 bp, Homo sapiens
acctgttacaggaccaccacctcc

SEQ ID NO: 16734 - DNA, 24 bp, Homo sapiens
cacctgttacaggaccaccacctc

SEQ ID NO: 16735 - DNA, 24 bp, Homo sapiens
ccacctgttacaggaccaccacct

SEQ ID NO: 16736 - DNA, 24 bp, Homo sapiens
aacccacacatgtgagtattcttg

SEQ ID NO: 16737 - DNA, 24 bp, Homo sapiens
aaacccacacatgtgagtattctt

SEQ ID NO: 16738 - DNA, 24 bp, Homo sapiens
aaaacccacacatgtgagtattct

SEQ ID NO: 16739 - DNA, 24 bp, Homo sapiens
tcttcagagagggtgactgttgga

SEQ ID NO: 16740 - DNA, 24 bp, Homo sapiens
ctcttcagagagggtgactgttgg

SEQ ID NO: 16741 - DNA, 24 bp, Homo sapiens
actcttcagagagggtgactgttg

SEQ ID NO: 16742 - DNA, 24 bp, Homo sapiens
agcaaggtttactctgaatcccaa

SEQ ID NO: 16743 - DNA, 24 bp, Homo sapiens
agttgaattttgcaaatccacctt

SEQ ID NO: 16744 - DNA, 24 bp, Homo sapiens
tggacgaggagcttatggttctgt

SEQ ID NO: 16745 - DNA, 24 bp, Homo sapiens
caagtgggcaaataatggcagtta

SEQ ID NO: 16746 - DNA, 24 bp, Homo sapiens
tagtaatgcggagtagtgattgcc

SEQ ID NO: 16747 - DNA, 24 bp, Homo sapiens
tatctgccttgggctcctggtgca

SEQ ID NO: 16748 - DNA, 24 bp, Homo sapiens
ttatctgccttgggctcctggtgc

SEQ ID NO: 16749 - DNA, 24 bp, Homo sapiens
tttatctgccttgggctcctggtg

SEQ ID NO: 16750 - DNA, 24 bp, Homo sapiens
tgacttctatatggacctgacgtc

SEQ ID NO: 16751 - DNA, 24 bp, Homo sapiens
ttgacttctatatggacctgacgt

SEQ ID NO: 16752 - DNA, 24 bp, Homo sapiens
tttgacttctatatggacctgacg

SEQ ID NO: 16753 - DNA, 24 bp, Homo sapiens
tgacttctatagtaagtttttctt

SEQ ID NO: 16754 - DNA, 24 bp, Homo sapiens
ttgacttctatagtaagtttttct

SEQ ID NO: 16755 - DNA, 24 bp, Homo sapiens
tttgacttctatagtaagtttttc

SEQ ID NO: 16756 - DNA, 24 bp, Homo sapiens
tgacttctatagagagtgacaaga

SEQ ID NO: 16757 - DNA, 24 bp, Homo sapiens
ttgacttctatagagagtgacaag

SEQ ID NO: 16758 - DNA, 24 bp, Homo sapiens
tttgacttctatagagagtgacaa

SEQ ID NO: 16759 - DNA, 24 bp, Homo sapiens
tgcttgtttaggtccctttctaga

SEQ ID NO: 16760 - DNA, 24 bp, Homo sapiens
ttgcttgtttaggtccctttctag

SEQ ID NO: 16761 - DNA, 24 bp, Homo sapiens
tttgcttgtttaggtccctttcta

SEQ ID NO: 16762 - DNA, 24 bp, Homo sapiens
aaccttaaccaaatcggcagcagc

SEQ ID NO: 16763 - DNA, 24 bp, Homo sapiens
gccagtcaactagccctttcagcg

SEQ ID NO: 16764 - DNA, 24 bp, Homo sapiens
gccagtcgtcaggttgcatctcag

SEQ ID NO: 16765 - DNA, 24 bp, Homo sapiens
accgactgcctcattagtcacagg

SEQ ID NO: 16766 - DNA, 24 bp, Homo sapiens
caccgactgcctcattagtcacag

SEQ ID NO: 16767 - DNA, 24 bp, Homo sapiens
tcaccgactgcctcattagtcaca

SEQ ID NO: 16768 - DNA, 24 bp, Homo sapiens
ttcactcatcggaaacgctgaccc

SEQ ID NO: 16769 - DNA, 24 bp, Homo sapiens
tgaaccacacagccgagcatttgt

SEQ ID NO: 16770 - DNA, 24 bp, Homo sapiens
gcagctcagtgaagaagcctcctt

SEQ ID NO: 16771 - DNA, 24 bp, Homo sapiens
gggtgattgaatttgtatcttatt

SEQ ID NO: 16772 - DNA, 24 bp, Homo sapiens
aagacaagccaggttccagacgac

SEQ ID NO: 16773 - DNA, 24 bp, Homo sapiens
tgaaaagagctttggaaaagttgg

SEQ ID NO: 16774 - DNA, 24 bp, Homo sapiens
caggaagccatgtgacgaccgcaa

SEQ ID NO: 16775 - DNA, 24 bp, Homo sapiens
actgcctgttccatttgctgacct

SEQ ID NO: 16776 - DNA, 24 bp, Homo sapiens
gcgtggctctttgaaccattgtgg

SEQ ID NO: 16777 - DNA, 24 bp, Homo sapiens
cctttgtggtgagcgagtaattgt

SEQ ID NO: 16778 - DNA, 24 bp, Homo sapiens
tgtggagtttgatgatctgcgtga

SEQ ID NO: 16779 - DNA, 24 bp, Homo sapiens
tgatgctgtttatgaactgaatgg

SEQ ID NO: 16780 - DNA, 24 bp, Homo sapiens
actgcctgttccatttgctgacct

SEQ ID NO: 16781 - DNA, 24 bp, Homo sapiens
gcgtggctctttgaaccattgtgg

SEQ ID NO: 16782 - DNA, 24 bp, Homo sapiens
ccgcaacctttccccattagacct

SEQ ID NO: 16783 - DNA, 24 bp, Homo sapiens
ctgctgatggttggctgaggactg

SEQ ID NO: 16784 - DNA, 24 bp, Homo sapiens
ttcggaaggaccagatggctgaca

SEQ ID NO: 16785 - DNA, 24 bp, Homo sapiens
tggagaggttcggttcttacaagg

SEQ ID NO: 16786 - DNA, 24 bp, Homo sapiens
gcacaccgacctaaattaaatgaa

SEQ ID NO: 16787 - DNA, 24 bp, Homo sapiens
ttgagtttgcctcttatggtgact

SEQ ID NO: 16788 - DNA, 24 bp, Homo sapiens
tctggaaaggaaataaatgggaga

SEQ ID NO: 16789 - DNA, 24 bp, Homo sapiens
taacgcttccgaataagaggtccg

SEQ ID NO: 16790 - DNA, 24 bp, Homo sapiens
ggctgtcgggtattcatcgggaga

SEQ ID NO: 16791 - DNA, 24 bp, Homo sapiens
ctgtctgggtctcagccgccaaag

SEQ ID NO: 16792 - DNA, 24 bp, Homo sapiens
cgagttaagtcctggtctgcgtgg

SEQ ID NO: 16793 - DNA, 24 bp, Homo sapiens
acgaggtggaagaggtagaggacg

SEQ ID NO: 16794 - DNA, 24 bp, Homo sapiens
ggtatgtgaagggtggatggctgc

SEQ ID NO: 16795 - DNA, 24 bp, Homo sapiens
ggtcctgccgtataatctgttctt

SEQ ID NO: 16796 - DNA, 23 bp, Homo sapiens
tgattctcctgtctcaccctcct

SEQ ID NO: 16797 - DNA, 23 bp, Homo sapiens
ctcactgcaacctccgcctccca

SEQ ID NO: 16798 - DNA, 23 bp, Homo sapiens
acccaggctggagtgcagtggca

SEQ ID NO: 16799 - DNA, 24 bp, Homo sapiens
agctgatgaagcccttgaaggtag

SEQ ID NO: 16800 - DNA, 24 bp, Homo sapiens
gagctgatgaagcccttgaaggta

SEQ ID NO: 16801 - DNA, 24 bp, Homo sapiens
agagctgatgaagcccttgaaggt

SEQ ID NO: 16802 - DNA, 24 bp, Homo sapiens
ggataaaagaggtctagatgtgga

SEQ ID NO: 16803 - DNA, 24 bp, Homo sapiens
tggataaaagaggtctagatgtgg

SEQ ID NO: 16804 - DNA, 24 bp, Homo sapiens
gtggataaaagaggtctagatgtg

SEQ ID NO: 16805 - DNA, 24 bp, Homo sapiens
aacccaaacagaaagcctcacatt

SEQ ID NO: 16806 - DNA, 24 bp, Homo sapiens
aaacccaaacagaaagcctcacat

SEQ ID NO: 16807 - DNA, 24 bp, Homo sapiens
caaacccaaacagaaagcctcaca

SEQ ID NO: 16808 - DNA, 24 bp, Homo sapiens
ggccccacaaggtacttggaggaa

SEQ ID NO: 16809 - DNA, 24 bp, Homo sapiens
gggccccacaaggtacttggagga

SEQ ID NO: 16810 - DNA, 24 bp, Homo sapiens
tgggccccacaaggtacttggagg

SEQ ID NO: 16811 - DNA, 25 bp, Homo sapiens
tgagtgggatgacattcatgtggtc

SEQ ID NO: 16812 - DNA, 23 bp, Homo sapiens
ctctggtgccaccactgctgctg

SEQ ID NO: 16813 - DNA, 23 bp, Homo sapiens
cctgaagctttttctccgggagc

SEQ ID NO: 16814 - DNA, 23 bp, Homo sapiens
ccgaaggcaccgagcagaaccgc

SEQ ID NO: 16815 - DNA, 25 bp, Homo sapiens
gaagagaccgcccttacaaagcctg

SEQ ID NO: 16816 - DNA, 24 bp, Homo sapiens
gctgccagttggaatcactctgcc

SEQ ID NO: 16817 - DNA, 24 bp, Homo sapiens
cagcacacccagaaagcctcacat

SEQ ID NO: 16818 - DNA, 25 bp, Homo sapiens
accaactcctgctcctgaatcttct

SEQ ID NO: 16819 - DNA, 24 bp, Homo sapiens
aggtgacagtgctggctacaatgc

SEQ ID NO: 16820 - DNA, 25 bp, Homo sapiens
accaactcctgctcctgaatcttct

SEQ ID NO: 16821 - DNA, 24 bp, Homo sapiens
aggtgacagtgctggctacaatgc

SEQ ID NO: 16822 - DNA, 23 bp, Homo sapiens
ctccgactggtggttggcaagac

SEQ ID NO: 16823 - DNA, 24 bp, Homo sapiens
gaccaactcctgctcctgaatctt

SEQ ID NO: 16824 - DNA, 25 bp, Homo sapiens
gctctgtgccctctatgcctttact

SEQ ID NO: 16825 - DNA, 23 bp, Homo sapiens
ctccgactggtggttggcaagac

SEQ ID NO: 16826 - DNA, 23 bp, Homo sapiens
cccatcttcgtcccagcagccta

SEQ ID NO: 16827 - DNA, 25 bp, Homo sapiens
gaagagaccgcccttacaaagcctg

SEQ ID NO: 16828 - DNA, 24 bp, Homo sapiens
gctgccagttggaatcactctgcc

SEQ ID NO: 16829 - DNA, 24 bp, Homo sapiens
gcatttatcgggtgagcgggaact

SEQ ID NO: 16830 - DNA, 24 bp, Homo sapiens
ttctgcctaagtctcatgatcgat

SEQ ID NO: 16831 - DNA, 24 bp, Homo sapiens
tttctgcctaagtctcatgatcga

SEQ ID NO: 16832 - DNA, 24 bp, Homo sapiens
ttttctgcctaagtctcatgatcg

SEQ ID NO: 16833 - DNA, 25 bp, Homo sapiens
gagggaaactgtctgtcatcaagcg

SEQ ID NO: 16834 - DNA, 24 bp, Homo sapiens
aagacttgaacagccaggagaggt

SEQ ID NO: 16835 - DNA, 24 bp, Homo sapiens
tgctacccaaaggcgacatagtgc

SEQ ID NO: 16836 - DNA, 25 bp, Homo sapiens
cacacgagaacgaaggaacagtaga

SEQ ID NO: 16837 - DNA, 25 bp, Homo sapiens
cctgctccagactcatcagttcaga

SEQ ID NO: 16838 - DNA, 25 bp, Homo sapiens
agatgagaatgtgaatgctgtgcca

SEQ ID NO: 16839 - DNA, 25 bp, Homo sapiens
agatgagaatgtgaatgctgtgcca

SEQ ID NO: 16840 - DNA, 25 bp, Homo sapiens
cctgctccagactcatcagttcaga

SEQ ID NO: 16841 - DNA, 25 bp, Homo sapiens
tcacacgagaacgaaggaacagtag

SEQ ID NO: 16842 - DNA, 25 bp, Homo sapiens
agcaggagagtgtcagagatgagcc

SEQ ID NO: 16843 - DNA, 25 bp, Homo sapiens
aggcagaatccactttgacatcagc

SEQ ID NO: 16844 - DNA, 23 bp, Homo sapiens
gcaatagtgggtctgaagcctgt

SEQ ID NO: 16845 - DNA, 24 bp, Homo sapiens
ctctgccttagctcccccgcgcct

SEQ ID NO: 16846 - DNA, 24 bp, Homo sapiens
cctctgccttagctcccccgcgcc

SEQ ID NO: 16847 - DNA, 24 bp, Homo sapiens
ccctctgccttagctcccccgcgc

SEQ ID NO: 16848 - DNA, 24 bp, Homo sapiens
tcaagggcaagcacatttgcaggt

SEQ ID NO: 16849 - DNA, 24 bp, Homo sapiens
ttcaagggcaagcacatttgcagg

SEQ ID NO: 16850 - DNA, 24 bp, Homo sapiens
gttcaagggcaagcacatttgcag

SEQ ID NO: 16851 - DNA, 23 bp, Homo sapiens
ggtgatctgccgcctgagcctcc

SEQ ID NO: 16852 - DNA, 24 bp, Homo sapiens
tgggattacaggcatgagccactg

SEQ ID NO: 16853 - DNA, 25 bp, Homo sapiens
atagacggggtttcaccatgttggc

SEQ ID NO: 16854 - DNA, 24 bp, Homo sapiens
ccccagaagagtttgtggcagctg

SEQ ID NO: 16855 - DNA, 24 bp, Homo sapiens
accccagaagagtttgtggcagct

SEQ ID NO: 16856 - DNA, 24 bp, Homo sapiens
taccccagaagagtttgtggcagc

SEQ ID NO: 16857 - DNA, 24 bp, Homo sapiens
agtgtttgatggtaagtttcttta

SEQ ID NO: 16858 - DNA, 24 bp, Homo sapiens
aagtgtttgatggtaagtttcttt

SEQ ID NO: 16859 - DNA, 24 bp, Homo sapiens
gaagtgtttgatggtaagtttctt

SEQ ID NO: 16860 - DNA, 24 bp, Homo sapiens
ctgcacctcggctttcctgctctg

SEQ ID NO: 16861 - DNA, 24 bp, Homo sapiens
cctgcacctcggctttcctgctct

SEQ ID NO: 16862 - DNA, 24 bp, Homo sapiens
gcctgcacctcggctttcctgctc

SEQ ID NO: 16863 - DNA, 24 bp, Homo sapiens
ctggttcaaaggaagcagaagtgc

SEQ ID NO: 16864 - DNA, 24 bp, Homo sapiens
cctggttcaaaggaagcagaagtg

SEQ ID NO: 16865 - DNA, 24 bp, Homo sapiens
acctggttcaaaggaagcagaagt

SEQ ID NO: 16866 - DNA, 24 bp, Homo sapiens
gctccacgcctcaacagtctaatt

SEQ ID NO: 16867 - DNA, 25 bp, Homo sapiens
gcaacagtatgaatggctacagcaa

SEQ ID NO: 16868 - DNA, 24 bp, Homo sapiens
caggatttctaaatggctcaccca

SEQ ID NO: 16869 - DNA, 24 bp, Homo sapiens
gccttggaagcctttgacctggat

SEQ ID NO: 16870 - DNA, 24 bp, Homo sapiens
tgcaacctcacgaccggatcatgg

SEQ ID NO: 16871 - DNA, 24 bp, Homo sapiens
gagtcaatgtccagccctactccg

SEQ ID NO: 16872 - DNA, 24 bp, Homo sapiens
cagccacgtccatcttcttcgagt

SEQ ID NO: 16873 - DNA, 24 bp, Homo sapiens
cctataagctcaaccccaaaactg

SEQ ID NO: 16874 - DNA, 24 bp, Homo sapiens
agctggcactgactgctcgacttt

SEQ ID NO: 16875 - DNA, 24 bp, Homo sapiens
tctgcaacctcacgaccggatcat

SEQ ID NO: 16876 - DNA, 24 bp, Homo sapiens
ttctgcaacctcacgaccggatca

SEQ ID NO: 16877 - DNA, 24 bp, Homo sapiens
cttctgcaacctcacgaccggatc

SEQ ID NO: 16878 - DNA, 24 bp, Homo sapiens
atgaccaactggaacctacaagca

SEQ ID NO: 16879 - DNA, 24 bp, Homo sapiens
catgaccaactggaacctacaagc

SEQ ID NO: 16880 - DNA, 24 bp, Homo sapiens
acatgaccaactggaacctacaag

SEQ ID NO: 16881 - DNA, 23 bp, Homo sapiens
agatcctcccacctcagccacct

SEQ ID NO: 16882 - DNA, 23 bp, Homo sapiens
aggctggagtgcagtggtgtgat

SEQ ID NO: 16883 - DNA, 23 bp, Homo sapiens
cactgcagccttgacctcccagg

SEQ ID NO: 16884 - DNA, 23 bp, Homo sapiens
ggcggatcacgaggtcaagagat

SEQ ID NO: 16885 - DNA, 25 bp, Homo sapiens
ctcacgcctgtaatcccagcacttt

SEQ ID NO: 16886 - DNA, 23 bp, Homo sapiens
gccaacatggtgaaaccccatct

SEQ ID NO: 16887 - DNA, 25 bp, Homo sapiens
actcaggctggtctggaactactgg

SEQ ID NO: 16888 - DNA, 23 bp, Homo sapiens
caattccccagcctcagcctcct

SEQ ID NO: 16889 - DNA, 23 bp, Homo sapiens
catccgtgggggtctgcaatggc

SEQ ID NO: 16890 - DNA, 23 bp, Homo sapiens
gctgtctcctgcctactgcccag

SEQ ID NO: 16891 - DNA, 24 bp, Homo sapiens
gatctggctgctccttgccatctg

SEQ ID NO: 16892 - DNA, 24 bp, Homo sapiens
cctggagataggacgcgtgaccaa

SEQ ID NO: 16893 - DNA, 24 bp, Homo sapiens
tcctggagataggacgcgtgacca

SEQ ID NO: 16894 - DNA, 24 bp, Homo sapiens
gtcctggagataggacgcgtgacc

SEQ ID NO: 16895 - DNA, 24 bp, Homo sapiens
ttgaccagagggtatgcatccatg

SEQ ID NO: 16896 - DNA, 24 bp, Homo sapiens
gttgaccagagggtatgcatccat

SEQ ID NO: 16897 - DNA, 24 bp, Homo sapiens
ggttgaccagagggtatgcatcca

SEQ ID NO: 16898 - DNA, 24 bp, Homo sapiens
aaaattggggatctaggtgcggtg

SEQ ID NO: 16899 - DNA, 24 bp, Homo sapiens
aaaaattggggatctaggtgcggt

SEQ ID NO: 16900 - DNA, 24 bp, Homo sapiens
aaaaaattggggatctaggtgcgg

SEQ ID NO: 16901 - DNA, 23 bp, Homo sapiens
cggccatgaagtgagatcgtgca

SEQ ID NO: 16902 - DNA, 23 bp, Homo sapiens
aaacgggcagcatcactatttcc

SEQ ID NO: 16903 - DNA, 25 bp, Homo sapiens
agatcggaggtcttatacagccagg

SEQ ID NO: 16904 - DNA, 23 bp, Homo sapiens
cggccatgaagtgagatcgtgca

SEQ ID NO: 16905 - DNA, 23 bp, Homo sapiens
cagataaaacgggcagcatcact

SEQ ID NO: 16906 - DNA, 24 bp, Homo sapiens
gtgtgggatgagatcggaggtctt

SEQ ID NO: 16907 - DNA, 24 bp, Homo sapiens
agcaccagcaggaatgaaaggaat

SEQ ID NO: 16908 - DNA, 24 bp, Homo sapiens
cagcaccagcaggaatgaaaggaa

SEQ ID NO: 16909 - DNA, 24 bp, Homo sapiens
gcagcaccagcaggaatgaaagga

SEQ ID NO: 16910 - DNA, 25 bp, Homo sapiens
atctcttctgcttgccgtcttgtgt

SEQ ID NO: 16911 - DNA, 23 bp, Homo sapiens
acaccgtcttggaattagcccgc

SEQ ID NO: 16912 - DNA, 25 bp, Homo sapiens
atataggcaccaagtcaatggcagc

SEQ ID NO: 16913 - DNA, 25 bp, Homo sapiens
tccagaagaagcagcaagaacagaa

SEQ ID NO: 16914 - DNA, 23 bp, Homo sapiens
cctattggtatcgttgtggcagc

SEQ ID NO: 16915 - DNA, 25 bp, Homo sapiens
caccgagtccaatgagttcttctga

SEQ ID NO: 16916 - DNA, 25 bp, Homo sapiens
caccgagtccaatgagttcttctga

SEQ ID NO: 16917 - DNA, 24 bp, Homo sapiens
gcactcaccattcgctctccaact

SEQ ID NO: 16918 - DNA, 25 bp, Homo sapiens
gcagtgctacaggaacaacagaaga

SEQ ID NO: 16919 - DNA, 24 bp, Homo sapiens
tgagtcagaagattcagcgtttgt

SEQ ID NO: 16920 - DNA, 24 bp, Homo sapiens
gtgagtcagaagattcagcgtttg

SEQ ID NO: 16921 - DNA, 24 bp, Homo sapiens
agtgagtcagaagattcagcgttt

SEQ ID NO: 16922 - DNA, 24 bp, Homo sapiens
ggttcaagcgattctcctgcctca

SEQ ID NO: 16923 - DNA, 23 bp, Homo sapiens
cagcctggtcttgaactcctgac

SEQ ID NO: 16924 - DNA, 23 bp, Homo sapiens
attacaggcacccaccaccacac

SEQ ID NO: 16925 - DNA, 24 bp, Homo sapiens
taagcgattctcctgcctcagcct

SEQ ID NO: 16926 - DNA, 23 bp, Homo sapiens
cgatctcggctcactgcaacctc

SEQ ID NO: 16927 - DNA, 24 bp, Homo sapiens
tgttcaagaagatgtccaactcag

SEQ ID NO: 16928 - DNA, 24 bp, Homo sapiens
tccagcacctaacagagcgtttaa

SEQ ID NO: 16929 - DNA, 24 bp, Homo sapiens
ctgcaccccaggcctttcagaaaa

SEQ ID NO: 16930 - DNA, 24 bp, Homo sapiens
cctgcaccccaggcctttcagaaa

SEQ ID NO: 16931 - DNA, 24 bp, Homo sapiens
acctgcaccccaggcctttcagaa

SEQ ID NO: 16932 - DNA, 23 bp, Homo sapiens
gacttcaccttctacccacgccg

SEQ ID NO: 16933 - DNA, 25 bp, Homo sapiens
gctgagggcacctttattgtctggg

SEQ ID NO: 16934 - DNA, 25 bp, Homo sapiens
cccatccacccagacaagcaataaa

SEQ ID NO: 16935 - DNA, 24 bp, Homo sapiens
cagcacctcggccgtcctgggccg

SEQ ID NO: 16936 - DNA, 24 bp, Homo sapiens
tcagcacctcggccgtcctgggcc

SEQ ID NO: 16937 - DNA, 24 bp, Homo sapiens
ttcagcacctcggccgtcctgggc

SEQ ID NO: 16938 - DNA, 24 bp, Homo sapiens
atgcaggacagttggcagaactga

SEQ ID NO: 16939 - DNA, 24 bp, Homo sapiens
tatgcaggacagttggcagaactg

SEQ ID NO: 16940 - DNA, 24 bp, Homo sapiens
atatgcaggacagttggcagaact

SEQ ID NO: 16941 - DNA, 24 bp, Homo sapiens
catgggtagagccttgatacatca

SEQ ID NO: 16942 - DNA, 24 bp, Homo sapiens
gcatgggtagagccttgatacatc

SEQ ID NO: 16943 - DNA, 24 bp, Homo sapiens
tgcatgggtagagccttgatacat

SEQ ID NO: 16944 - DNA, 23 bp, Homo sapiens
cctgtcttcatctacttcctgtt

SEQ ID NO: 16945 - DNA, 23 bp, Homo sapiens
tatcctgtgcgtgactggctcct

SEQ ID NO: 16946 - DNA, 25 bp, Homo sapiens
ctatgcccttctgctccaacacctc

SEQ ID NO: 16947 - DNA, 23 bp, Homo sapiens
tatcctgtgcgtgactggctcct

SEQ ID NO: 16948 - DNA, 25 bp, Homo sapiens
ctatgcccttctgctccaacacctc

SEQ ID NO: 16949 - DNA, 23 bp, Homo sapiens
cctgttatccggcctgagtgtgg

SEQ ID NO: 16950 - DNA, 24 bp, Homo sapiens
tgaaggaactgacgcatctcaagg

SEQ ID NO: 16951 - DNA, 24 bp, Homo sapiens
ctgaaggaactgacgcatctcaag

SEQ ID NO: 16952 - DNA, 24 bp, Homo sapiens
cctgaaggaactgacgcatctcaa

SEQ ID NO: 16953 - DNA, 24 bp, Homo sapiens
aacagatacagttgctgcctctac

SEQ ID NO: 16954 - DNA, 24 bp, Homo sapiens
taacagatacagttgctgcctcta

SEQ ID NO: 16955 - DNA, 24 bp, Homo sapiens
ataacagatacagttgctgcctct

SEQ ID NO: 16956 - DNA, 24 bp, Homo sapiens
ctctaacccagtcccagcaacctc

SEQ ID NO: 16957 - DNA, 24 bp, Homo sapiens
tctctaacccagtcccagcaacct

SEQ ID NO: 16958 - DNA, 24 bp, Homo sapiens
ttctctaacccagtcccagcaacc

SEQ ID NO: 16959 - DNA, 24 bp, Homo sapiens
ctgcggttggtcctgtgtccatgg

SEQ ID NO: 16960 - DNA, 24 bp, Homo sapiens
tctgcggttggtcctgtgtccatg

SEQ ID NO: 16961 - DNA, 24 bp, Homo sapiens
ttctgcggttggtcctgtgtccat

SEQ ID NO: 16962 - DNA, 25 bp, Homo sapiens
cacctctttctccttccctcctccg

SEQ ID NO: 16963 - DNA, 25 bp, Homo sapiens
accaatgaatacatccaggcaacaa

SEQ ID NO: 16964 - DNA, 24 bp, Homo sapiens
cattggagagtgtcctgcctatgc

SEQ ID NO: 16965 - DNA, 23 bp, Homo sapiens
cctcggttgttccagtccactct

SEQ ID NO: 16966 - DNA, 25 bp, Homo sapiens
ctcctacaaccagcagttcagtcca

SEQ ID NO: 16967 - DNA, 25 bp, Homo sapiens
caactcctcatgtgtctacggctca

SEQ ID NO: 16968 - DNA, 23 bp, Homo sapiens
acctagatggtgacaaccccgag

SEQ ID NO: 16969 - DNA, 23 bp, Homo sapiens
cgagtagtagaatgtcaattaga

SEQ ID NO: 16970 - DNA, 23 bp, Homo sapiens
taataggaaaatggttacattca

SEQ ID NO: 16971 - DNA, 25 bp, Homo sapiens
gccttcctagccagaatctaagtca

SEQ ID NO: 16972 - DNA, 25 bp, Homo sapiens
gctgttcttcctgctgtgataccaa

SEQ ID NO: 16973 - DNA, 25 bp, Homo sapiens
aactgaggacaagatcactgacaca

SEQ ID NO: 16974 - DNA, 25 bp, Homo sapiens
aggaagggcacattcacagatgact

SEQ ID NO: 16975 - DNA, 23 bp, Homo sapiens
caagctcagcctcctgccatgac

SEQ ID NO: 16976 - DNA, 23 bp, Homo sapiens
gttggggcaacagtgaacagcca

SEQ ID NO: 16977 - DNA, 25 bp, Homo sapiens
ccatacaacatcctcagcagcagca

SEQ ID NO: 16978 - DNA, 25 bp, Homo sapiens
accaactatccaaggcgaacctcag

SEQ ID NO: 16979 - DNA, 23 bp, Homo sapiens
cctcggttgttccagtccactct

SEQ ID NO: 16980 - DNA, 25 bp, Homo sapiens
ctcctacaaccagcagttcagtcca

SEQ ID NO: 16981 - DNA, 25 bp, Homo sapiens
caactcctcatgtgtctacggctca

SEQ ID NO: 16982 - DNA, 23 bp, Homo sapiens
gctccctactcccttgctccctc

SEQ ID NO: 16983 - DNA, 25 bp, Homo sapiens
aacaaccaattcctgcgtcttccat

SEQ ID NO: 16984 - DNA, 25 bp, Homo sapiens
ctggaatgaacttgtctcactctgc

SEQ ID NO: 16985 - DNA, 25 bp, Homo sapiens
gtgcccaaatgacagaaggacccaa

SEQ ID NO: 16986 - DNA, 23 bp, Homo sapiens
aggtactctacccagcgagcagc

SEQ ID NO: 16987 - DNA, 24 bp, Homo sapiens
ccctcctggtcagcctcccgagta

SEQ ID NO: 16988 - DNA, 24 bp, Homo sapiens
tccctcctggtcagcctcccgagt

SEQ ID NO: 16989 - DNA, 24 bp, Homo sapiens
atccctcctggtcagcctcccgag

SEQ ID NO: 16990 - DNA, 23 bp, Homo sapiens
agtgctgggattacaggcgtgag

SEQ ID NO: 16991 - DNA, 23 bp, Homo sapiens
cttgtgatccgcctgccttggcc

SEQ ID NO: 16992 - DNA, 23 bp, Homo sapiens
attggccaggctggtcttaaact

SEQ ID NO: 16993 - DNA, 23 bp, Homo sapiens
gtgctagaagaccctgccatcgc

SEQ ID NO: 16994 - DNA, 23 bp, Homo sapiens
cgctgctgtacgcttcctcgctt

SEQ ID NO: 16995 - DNA, 24 bp, Homo sapiens
tgaaggtcagggtggtgaaggagc

SEQ ID NO: 16996 - DNA, 23 bp, Homo sapiens
cgctgtccttccggcccatcgtg

SEQ ID NO: 16997 - DNA, 23 bp, Homo sapiens
catcatgatcacgcccatctgcc

SEQ ID NO: 16998 - DNA, 23 bp, Homo sapiens
gcctccatgatccaccccaacgt

SEQ ID NO: 16999 - DNA, 24 bp, Homo sapiens
gccgtgttccgtgtctctggattc

SEQ ID NO: 17000 - DNA, 23 bp, Homo sapiens
cctgtacttcactgtggtcctga

SEQ ID NO: 17001 - DNA, 24 bp, Homo sapiens
gagctgtgtttttcaggaagactt

SEQ ID NO: 17002 - DNA, 24 bp, Homo sapiens
tgaaggtcagggtggtgaaggagc

SEQ ID NO: 17003 - DNA, 23 bp, Homo sapiens
caatgggctgggtgagaacggct

SEQ ID NO: 17004 - DNA, 25 bp, Homo sapiens
gaatgaggtggtgattgacagaggc

SEQ ID NO: 17005 - DNA, 23 bp, Homo sapiens
cctcctcctacctgtccaatgtg

SEQ ID NO: 17006 - DNA, 24 bp, Homo sapiens
tacctggacggacacctcatcacc

SEQ ID NO: 17007 - DNA, 25 bp, Homo sapiens
tgtcacctgaagcaaggaacacagc

SEQ ID NO: 17008 - DNA, 24 bp, Homo sapiens
gatgccgccggctgctggctacca

SEQ ID NO: 17009 - DNA, 24 bp, Homo sapiens
cgatgccgccggctgctggctacc

SEQ ID NO: 17010 - DNA, 24 bp, Homo sapiens
ccgatgccgccggctgctggctac

SEQ ID NO: 17011 - DNA, 24 bp, Homo sapiens
tcctttccccgctgctggctacca

SEQ ID NO: 17012 - DNA, 24 bp, Homo sapiens
ttcctttccccgctgctggctacc

SEQ ID NO: 17013 - DNA, 24 bp, Homo sapiens
cttcctttccccgctgctggctac

SEQ ID NO: 17014 - DNA, 24 bp, Homo sapiens
tctgcccccagggcgtcctcgcgg

SEQ ID NO: 17015 - DNA, 24 bp, Homo sapiens
ctctgcccccagggcgtcctcgcg

SEQ ID NO: 17016 - DNA, 24 bp, Homo sapiens
gctctgcccccagggcgtcctcgc

SEQ ID NO: 17017 - DNA, 24 bp, Homo sapiens
ctgttccccaggcaggcatctatt

SEQ ID NO: 17018 - DNA, 24 bp, Homo sapiens
gctgttccccaggcaggcatctat

SEQ ID NO: 17019 - DNA, 24 bp, Homo sapiens
cgctgttccccaggcaggcatcta

SEQ ID NO: 17020 - DNA, 24 bp, Homo sapiens
tggaggccaaggtgtggggtgatg

SEQ ID NO: 17021 - DNA, 24 bp, Homo sapiens
ctggaggccaaggtgtggggtgat

SEQ ID NO: 17022 - DNA, 24 bp, Homo sapiens
cctggaggccaaggtgtggggtga

SEQ ID NO: 17023 - DNA, 24 bp, Homo sapiens
tcctcccccagcctccctgtttgt

SEQ ID NO: 17024 - DNA, 24 bp, Homo sapiens
ctcctcccccagcctccctgtttg

SEQ ID NO: 17025 - DNA, 24 bp, Homo sapiens
actcctcccccagcctccctgttt

SEQ ID NO: 17026 - DNA, 24 bp, Homo sapiens
catggaggacagccccactatggt

SEQ ID NO: 17027 - DNA, 24 bp, Homo sapiens
ccaggtttcgccatgtcaagggag

SEQ ID NO: 17028 - DNA, 24 bp, Homo sapiens
acatgaaagaacttgccaaccagc

SEQ ID NO: 17029 - DNA, 24 bp, Homo sapiens
ccgtggtgctccagttcattgact

SEQ ID NO: 17030 - DNA, 24 bp, Homo sapiens
ggcatatcccaagtggtgttcgtc

SEQ ID NO: 17031 - DNA, 24 bp, Homo sapiens
gctctcactggctggctgggaaca

SEQ ID NO: 17032 - DNA, 24 bp, Homo sapiens
ctacggaccttccgcctgcactcc

SEQ ID NO: 17033 - DNA, 24 bp, Homo sapiens
gctacggaccttccgcctgcactc

SEQ ID NO: 17034 - DNA, 24 bp, Homo sapiens
agctacggaccttccgcctgcact

SEQ ID NO: 17035 - DNA, 24 bp, Homo sapiens
ctacggaccttccgcctgcactcc

SEQ ID NO: 17036 - DNA, 24 bp, Homo sapiens
gctacggaccttccgcctgcactc

SEQ ID NO: 17037 - DNA, 24 bp, Homo sapiens
agctacggaccttccgcctgcact

SEQ ID NO: 17038 - DNA, 23 bp, Homo sapiens
tctgtatctcctgacctcgtgat

SEQ ID NO: 17039 - DNA, 23 bp, Homo sapiens
atgccattctcctgcctcagcct

SEQ ID NO: 17040 - DNA, 23 bp, Homo sapiens
acacaagtcttctatcactataa

SEQ ID NO: 17041 - DNA, 24 bp, Homo sapiens
aatgagagcacacctattcagcaa

SEQ ID NO: 17042 - DNA, 23 bp, Homo sapiens
gaacacttcctccgccagcttca

SEQ ID NO: 17043 - DNA, 24 bp, Homo sapiens
agagaagcttgaaggagctgaaga

SEQ ID NO: 17044 - DNA, 24 bp, Homo sapiens
cagagaagcttgaaggagctgaag

SEQ ID NO: 17045 - DNA, 24 bp, Homo sapiens
ccagagaagcttgaaggagctgaa

SEQ ID NO: 17046 - DNA, 24 bp, Homo sapiens
agaaagaagctctagaacaacaga

SEQ ID NO: 17047 - DNA, 24 bp, Homo sapiens
gagaaagaagctctagaacaacag

SEQ ID NO: 17048 - DNA, 24 bp, Homo sapiens
agagaaagaagctctagaacaaca

SEQ ID NO: 17049 - DNA, 24 bp, Homo sapiens
accccagccaggtcagataccagg

SEQ ID NO: 17050 - DNA, 24 bp, Homo sapiens
caccccagccaggtcagataccag

SEQ ID NO: 17051 - DNA, 24 bp, Homo sapiens
ccaccccagccaggtcagatacca

SEQ ID NO: 17052 - DNA, 24 bp, Homo sapiens
ttgctttccagggaacatttacgg

SEQ ID NO: 17053 - DNA, 24 bp, Homo sapiens
tttgctttccagggaacatttacg

SEQ ID NO: 17054 - DNA, 24 bp, Homo sapiens
atttgctttccagggaacatttac

SEQ ID NO: 17055 - DNA, 24 bp, Homo sapiens
aagaaagatcaagtccctggtagc

SEQ ID NO: 17056 - DNA, 24 bp, Homo sapiens
ggttgagacacaaatgaagaaact

SEQ ID NO: 17057 - DNA, 24 bp, Homo sapiens
gacagcaaatggaacagcagcagc

SEQ ID NO: 17058 - DNA, 24 bp, Homo sapiens
tggtggtgcagcttcttcagttcc

SEQ ID NO: 17059 - DNA, 24 bp, Homo sapiens
tgttcatgcggatgctcctaccaa

SEQ ID NO: 17060 - DNA, 24 bp, Homo sapiens
ctggattcggtgcgggtctggctg

SEQ ID NO: 17061 - DNA, 24 bp, Homo sapiens
gaacagggatggcggaggtttgac

SEQ ID NO: 17062 - DNA, 24 bp, Homo sapiens
tcatggatttcaaagctggaggcg

SEQ ID NO: 17063 - DNA, 24 bp, Homo sapiens
tggtggtgcagcttcttcagttcc

SEQ ID NO: 17064 - DNA, 24 bp, Homo sapiens
ccgaaggaaatgttgccacagccg

SEQ ID NO: 17065 - DNA, 24 bp, Homo sapiens
aagaaagatcaagtccctggtagc

SEQ ID NO: 17066 - DNA, 24 bp, Homo sapiens
ggttgagacacaaatgaagaaact

SEQ ID NO: 17067 - DNA, 24 bp, Homo sapiens
ctcaacaggcacaccagcactcag

SEQ ID NO: 17068 - DNA, 24 bp, Homo sapiens
gacagcaaatggaacagcagcagc

SEQ ID NO: 17069 - DNA, 24 bp, Homo sapiens
cctccctaccctctgatgcaccac

SEQ ID NO: 17070 - DNA, 23 bp, Homo sapiens
ccgaagtccaagtggcgaagcaa

SEQ ID NO: 17071 - DNA, 24 bp, Homo sapiens
atgacctacgactactctacagcg

SEQ ID NO: 17072 - DNA, 23 bp, Homo sapiens
ggcatgttcacgcacaaggagtt

SEQ ID NO: 17073 - DNA, 24 bp, Homo sapiens
acgccgggcggccctctggacccc

SEQ ID NO: 17074 - DNA, 24 bp, Homo sapiens
gacgccgggcggccctctggaccc

SEQ ID NO: 17075 - DNA, 24 bp, Homo sapiens
cgacgccgggcggccctctggacc

SEQ ID NO: 17076 - DNA, 24 bp, Homo sapiens
gccccttgaaggatcacaaactct

SEQ ID NO: 17077 - DNA, 24 bp, Homo sapiens
agccccttgaaggatcacaaactc

SEQ ID NO: 17078 - DNA, 24 bp, Homo sapiens
aagccccttgaaggatcacaaact

SEQ ID NO: 17079 - DNA, 24 bp, Homo sapiens
attcaccatctcactcaccttgcc

SEQ ID NO: 17080 - DNA, 25 bp, Homo sapiens
cgacgagattccactacaaccttca

SEQ ID NO: 17081 - DNA, 25 bp, Homo sapiens
acttagtggacaggctgaagagact

SEQ ID NO: 17082 - DNA, 25 bp, Homo sapiens
aacttcacctgcaagcttccaaaga

SEQ ID NO: 17083 - DNA, 24 bp, Homo sapiens
cttcccagcaggccaggcctcatg

SEQ ID NO: 17084 - DNA, 24 bp, Homo sapiens
tcttcccagcaggccaggcctcat

SEQ ID NO: 17085 - DNA, 24 bp, Homo sapiens
ttcttcccagcaggccaggcctca

SEQ ID NO: 17086 - DNA, 24 bp, Homo sapiens
gctggcgtatgttcaggattggag

SEQ ID NO: 17087 - DNA, 24 bp, Homo sapiens
actgaatacacagcagcagaggaa

SEQ ID NO: 17088 - DNA, 24 bp, Homo sapiens
tggcttagacacaccgtcagagaa

SEQ ID NO: 17089 - DNA, 24 bp, Homo sapiens
tggcttagacacaccgtcagagaa

SEQ ID NO: 17090 - DNA, 25 bp, Homo sapiens
aagtgattctcctacctcagcctcc

SEQ ID NO: 17091 - DNA, 24 bp, Homo sapiens
agtggtgccatcacagcttactgc

SEQ ID NO: 17092 - DNA, 25 bp, Homo sapiens
agcctgcacctccacctactataga

SEQ ID NO: 17093 - DNA, 23 bp, Homo sapiens
atgtgtgctaaggctggtgtccc

SEQ ID NO: 17094 - DNA, 24 bp, Homo sapiens
atccaggtcttctgaacgaggcag

SEQ ID NO: 17095 - DNA, 24 bp, Homo sapiens
ctgcctctgccaggagtctaccaa

SEQ ID NO: 17096 - DNA, 24 bp, Homo sapiens
acacccattgaaggaaaccaggcg

SEQ ID NO: 17097 - DNA, 25 bp, Homo sapiens
aggactagcgaggaggagttgagag

SEQ ID NO: 17098 - DNA, 24 bp, Homo sapiens
tggactcccagatgttagcaacta

SEQ ID NO: 17099 - DNA, 24 bp, Homo sapiens
atggactcccagatgttagcaact

SEQ ID NO: 17100 - DNA, 24 bp, Homo sapiens
catggactcccagatgttagcaac

SEQ ID NO: 17101 - DNA, 24 bp, Homo sapiens
acacccattgaaggaaaccaggcg

SEQ ID NO: 17102 - DNA, 24 bp, Homo sapiens
ctgcctctgccaggagtctaccaa

SEQ ID NO: 17103 - DNA, 25 bp, Homo sapiens
atagtgcagaagatagaggaagtac

SEQ ID NO: 17104 - DNA, 25 bp, Homo sapiens
cggagaagatcaaggtctgtggtaa

SEQ ID NO: 17105 - DNA, 25 bp, Homo sapiens
ctcaccagtcagattaaggcgatca

SEQ ID NO: 17106 - DNA, 24 bp, Homo sapiens
atccaggtcttctgaacgaggcag

SEQ ID NO: 17107 - DNA, 24 bp, Homo sapiens
gtctttcgtggtcagtaaattccg

SEQ ID NO: 17108 - DNA, 24 bp, Homo sapiens
catggcgaccaacatcgagcagat

SEQ ID NO: 17109 - DNA, 25 bp, Homo sapiens
ggaggactagcgaggaggagttgag

SEQ ID NO: 17110 - DNA, 25 bp, Homo sapiens
ttgatcttgaagccatgagcatgtt

SEQ ID NO: 17111 - DNA, 23 bp, Homo sapiens
gtgaacgggcacttgctcagaaa

SEQ ID NO: 17112 - DNA, 24 bp, Homo sapiens
tcccctggcagaagagaacgagtt

SEQ ID NO: 17113 - DNA, 24 bp, Homo sapiens
gtcccctggcagaagagaacgagt

SEQ ID NO: 17114 - DNA, 24 bp, Homo sapiens
tgtcccctggcagaagagaacgag

SEQ ID NO: 17115 - DNA, 24 bp, Homo sapiens
agccaactgcgaaaaccccacaga

SEQ ID NO: 17116 - DNA, 24 bp, Homo sapiens
aagccaactgcgaaaaccccacag

SEQ ID NO: 17117 - DNA, 24 bp, Homo sapiens
gaagccaactgcgaaaaccccaca

SEQ ID NO: 17118 - DNA, 24 bp, Homo sapiens
ggccaattgccccacacacagcac

SEQ ID NO: 17119 - DNA, 24 bp, Homo sapiens
aggccaattgccccacacacagca

SEQ ID NO: 17120 - DNA, 24 bp, Homo sapiens
gaggccaattgccccacacacagc

SEQ ID NO: 17121 - DNA, 24 bp, Homo sapiens
gtctactacagggtggttggagag

SEQ ID NO: 17122 - DNA, 24 bp, Homo sapiens
tgtctactacagggtggttggaga

SEQ ID NO: 17123 - DNA, 24 bp, Homo sapiens
atgtctactacagggtggttggag

SEQ ID NO: 17124 - DNA, 24 bp, Homo sapiens
gttctcggcaggtgaatggctatg

SEQ ID NO: 17125 - DNA, 24 bp, Homo sapiens
ggttctcggcaggtgaatggctat

SEQ ID NO: 17126 - DNA, 24 bp, Homo sapiens
tggttctcggcaggtgaatggcta

SEQ ID NO: 17127 - DNA, 24 bp, Homo sapiens
cccggaatgtggtgagtcagccag

SEQ ID NO: 17128 - DNA, 24 bp, Homo sapiens
ccccggaatgtggtgagtcagcca

SEQ ID NO: 17129 - DNA, 24 bp, Homo sapiens
cccccggaatgtggtgagtcagcc

SEQ ID NO: 17130 - DNA, 24 bp, Homo sapiens
tgtctgcccaattactaccgctgc

SEQ ID NO: 17131 - DNA, 24 bp, Homo sapiens
cccaaactgctcccgctacttcca

SEQ ID NO: 17132 - DNA, 24 bp, Homo sapiens
ttgcggcgattattctgatgaagc

SEQ ID NO: 17133 - DNA, 24 bp, Homo sapiens
aaccctctggctactccactgtct

SEQ ID NO: 17134 - DNA, 24 bp, Homo sapiens
ggaagtgatccttgaggaagtgag

SEQ ID NO: 17135 - DNA, 24 bp, Homo sapiens
caaaccaaataccatctacattga

SEQ ID NO: 17136 - DNA, 24 bp, Homo sapiens
cccatgagagcagcccagtttgtc

SEQ ID NO: 17137 - DNA, 24 bp, Homo sapiens
gcatctcttgggcagtgaacagca

SEQ ID NO: 17138 - DNA, 24 bp, Homo sapiens
ggctactccactgtcttccgaagt

SEQ ID NO: 17139 - DNA, 24 bp, Homo sapiens
ggcacttcctggacctcactacta

SEQ ID NO: 17140 - DNA, 24 bp, Homo sapiens
gagaccacggcggaatcatcacgg

SEQ ID NO: 17141 - DNA, 24 bp, Homo sapiens
caggtcaatgccacggatgccttg

SEQ ID NO: 17142 - DNA, 24 bp, Homo sapiens
ggagaccacggcggaatcatcacg

SEQ ID NO: 17143 - DNA, 24 bp, Homo sapiens
ggcacttcctggacctcactacta

SEQ ID NO: 17144 - DNA, 24 bp, Homo sapiens
tggctcagtgggaaagaacttggc

SEQ ID NO: 17145 - DNA, 24 bp, Homo sapiens
gtgcttgatcgtcccagggctctg

SEQ ID NO: 17146 - DNA, 24 bp, Homo sapiens
gacttccgactcacaatcgtcaat

SEQ ID NO: 17147 - DNA, 24 bp, Homo sapiens
ggaagaacactggaagcaatgcct

SEQ ID NO: 17148 - DNA, 24 bp, Homo sapiens
tgtccagaggatgtgtccagcagt

SEQ ID NO: 17149 - DNA, 24 bp, Homo sapiens
agagaacacctgtcttcgcaacca

SEQ ID NO: 17150 - DNA, 24 bp, Homo sapiens
gtctgcgtgattgctctgatggct

SEQ ID NO: 17151 - DNA, 24 bp, Homo sapiens
tgccaggatggttccgatgaggat

SEQ ID NO: 17152 - DNA, 24 bp, Homo sapiens
ctgatgaagccaactgtaccgcca

SEQ ID NO: 17153 - DNA, 24 bp, Homo sapiens
cttcctggactgctcggacgagag

SEQ ID NO: 17154 - DNA, 24 bp, Homo sapiens
cagggagttccagtgcgaggacgg

SEQ ID NO: 17155 - DNA, 24 bp, Homo sapiens
ctgcattgtgctctcggagcgctg

SEQ ID NO: 17156 - DNA, 24 bp, Homo sapiens
acagcaggagtggttccaagatgt

SEQ ID NO: 17157 - DNA, 24 bp, Homo sapiens
gaagcagaaggtgtgattgtaggc

SEQ ID NO: 17158 - DNA, 24 bp, Homo sapiens
atgactttgtgaccctgaggaccc

SEQ ID NO: 17159 - DNA, 24 bp, Homo sapiens
gtcgtggaataggaaactggagcg

SEQ ID NO: 17160 - DNA, 24 bp, Homo sapiens
ctatacaccgtcagagtggctgcg

SEQ ID NO: 17161 - DNA, 24 bp, Homo sapiens
acagcaggagtggttccaagatgt

SEQ ID NO: 17162 - DNA, 24 bp, Homo sapiens
gtgagtcagccagaatgaccatca

SEQ ID NO: 17163 - DNA, 24 bp, Homo sapiens
gagtcagccagaatgaccatcaca

SEQ ID NO: 17164 - DNA, 24 bp, Homo sapiens
gtcagccagaatgaccatcacaaa

SEQ ID NO: 17165 - DNA, 24 bp, Homo sapiens
accatcacaaagtttatggtattt

SEQ ID NO: 17166 - DNA, 24 bp, Homo sapiens
gaccatcacaaagtttatggtatt

SEQ ID NO: 17167 - DNA, 24 bp, Homo sapiens
tgaccatcacaaagtttatggtat

SEQ ID NO: 17168 - DNA, 24 bp, Homo sapiens
ttttcactcaagtaggtgcaaaaa

SEQ ID NO: 17169 - DNA, 24 bp, Homo sapiens
cttttcactcaagtaggtgcaaaa

SEQ ID NO: 17170 - DNA, 24 bp, Homo sapiens
ccttttcactcaagtaggtgcaaa

SEQ ID NO: 17171 - DNA, 24 bp, Homo sapiens
ttccagagcctgagccaacagaag

SEQ ID NO: 17172 - DNA, 24 bp, Homo sapiens
tgtatgtcggcactgggtagagca

SEQ ID NO: 17173 - DNA, 24 bp, Homo sapiens
gcaagagacaatggaccaggtcat

SEQ ID NO: 17174 - DNA, 24 bp, Homo sapiens
tgtatgtcggcactgggtagagca

SEQ ID NO: 17175 - DNA, 24 bp, Homo sapiens
tatacagcctgtgcaactgcgagt

SEQ ID NO: 17176 - DNA, 24 bp, Homo sapiens
ttccagagcctgagccaacagaag

SEQ ID NO: 17177 - DNA, 24 bp, Homo sapiens
aacaccttctcctcacggcacaag

SEQ ID NO: 17178 - DNA, 24 bp, Homo sapiens
tctgccatcaccaccattgacaca

SEQ ID NO: 17179 - DNA, 24 bp, Homo sapiens
gctcaccactacatctccaacctc

SEQ ID NO: 17180 - DNA, 24 bp, Homo sapiens
gcgaagaaaccctttatctctccc

SEQ ID NO: 17181 - DNA, 24 bp, Homo sapiens
ttgaccaccaggtttctgtttaca

SEQ ID NO: 17182 - DNA, 24 bp, Homo sapiens
gctggttgggaattatgtaagaaa

SEQ ID NO: 17183 - DNA, 24 bp, Homo sapiens
agagagccctttgtctccaattca

SEQ ID NO: 17184 - DNA, 24 bp, Homo sapiens
cacctcaggagaacaaacttacta

SEQ ID NO: 17185 - DNA, 24 bp, Homo sapiens
agcatttatggcagaaattcgaca

SEQ ID NO: 17186 - DNA, 24 bp, Homo sapiens
gcactgggtagagcaccacttcta

SEQ ID NO: 17187 - DNA, 24 bp, Homo sapiens
tgagtggcatataagcagacctgg

SEQ ID NO: 17188 - DNA, 24 bp, Homo sapiens
gacctgctcaccttacacccaata

SEQ ID NO: 17189 - DNA, 24 bp, Homo sapiens
gcactgggtagagcaccacttcta

SEQ ID NO: 17190 - DNA, 24 bp, Homo sapiens
gcatatcttttgcaacgaatggaa

SEQ ID NO: 17191 - DNA, 24 bp, Homo sapiens
atacctttgaggcactgcaggaaa

SEQ ID NO: 17192 - DNA, 24 bp, Homo sapiens
catacctttgaggcactgcaggaa

SEQ ID NO: 17193 - DNA, 24 bp, Homo sapiens
ccatacctttgaggcactgcagga

SEQ ID NO: 17194 - DNA, 24 bp, Homo sapiens
atagtccacctccgccaccaccaa

SEQ ID NO: 17195 - DNA, 24 bp, Homo sapiens
tcacagagattcagactggctcag

SEQ ID NO: 17196 - DNA, 24 bp, Homo sapiens
aattcgccaagcactcctcctagc

SEQ ID NO: 17197 - DNA, 24 bp, Homo sapiens
aaactcctgacctcagcctcccaa

SEQ ID NO: 17198 - DNA, 24 bp, Homo sapiens
caaactcctgacctcagcctccca

SEQ ID NO: 17199 - DNA, 24 bp, Homo sapiens
tcaaactcctgacctcagcctccc

SEQ ID NO: 17200 - DNA, 24 bp, Homo sapiens
acctactgacgcagacaaattggc

SEQ ID NO: 17201 - DNA, 24 bp, Homo sapiens
gagcagccaatcagtgcagacctt

SEQ ID NO: 17202 - DNA, 24 bp, Homo sapiens
tttcgcaaggaatatgtccaacca

SEQ ID NO: 17203 - DNA, 24 bp, Homo sapiens
acagcaggtggagaggaaggagaa

SEQ ID NO: 17204 - DNA, 24 bp, Homo sapiens
agtgtatggcaagacctctcacct

SEQ ID NO: 17205 - DNA, 24 bp, Homo sapiens
cctggtcatactgtgggaaacgct

SEQ ID NO: 17206 - DNA, 24 bp, Homo sapiens
gcccctcccaggtctacatccgca

SEQ ID NO: 17207 - DNA, 24 bp, Homo sapiens
ggcccctcccaggtctacatccgc

SEQ ID NO: 17208 - DNA, 24 bp, Homo sapiens
tggcccctcccaggtctacatccg

SEQ ID NO: 17209 - DNA, 24 bp, Homo sapiens
attcaaacaaggaacctcaaagaa

SEQ ID NO: 17210 - DNA, 24 bp, Homo sapiens
gattcaaacaaggaacctcaaaga

SEQ ID NO: 17211 - DNA, 24 bp, Homo sapiens
cgattcaaacaaggaacctcaaag

SEQ ID NO: 17212 - DNA, 24 bp, Homo sapiens
atctcatgctggtacaaccccacc

SEQ ID NO: 17213 - DNA, 24 bp, Homo sapiens
catctcatgctggtacaaccccac

SEQ ID NO: 17214 - DNA, 24 bp, Homo sapiens
ccatctcatgctggtacaacccca

SEQ ID NO: 17215 - DNA, 24 bp, Homo sapiens
ccatggtttaggtacaaccccacc

SEQ ID NO: 17216 - DNA, 24 bp, Homo sapiens
accatggtttaggtacaaccccac

SEQ ID NO: 17217 - DNA, 24 bp, Homo sapiens
aaccatggtttaggtacaacccca

SEQ ID NO: 17218 - DNA, 24 bp, Homo sapiens
tgatgaagaaagcccagaggcaga

SEQ ID NO: 17219 - DNA, 24 bp, Homo sapiens
gtgatgaagaaagcccagaggcag

SEQ ID NO: 17220 - DNA, 24 bp, Homo sapiens
tgtgatgaagaaagcccagaggca

SEQ ID NO: 17221 - DNA, 24 bp, Homo sapiens
atcacacttgctgctggttcctgc

SEQ ID NO: 17222 - DNA, 24 bp, Homo sapiens
ccagatgcttcagtcaagttctca

SEQ ID NO: 17223 - DNA, 24 bp, Homo sapiens
aagtgctcagagacatggaagacc

SEQ ID NO: 17224 - DNA, 24 bp, Homo sapiens
agatatggcaaaggcggacaaggc

SEQ ID NO: 17225 - DNA, 24 bp, Homo sapiens
catcaagcagaaggatatcgacaa

SEQ ID NO: 17226 - DNA, 24 bp, Homo sapiens
gcatcaagcagaaggatatcgaca

SEQ ID NO: 17227 - DNA, 24 bp, Homo sapiens
ggcatcaagcagaaggatatcgac

SEQ ID NO: 17228 - DNA, 24 bp, Homo sapiens
aaatccctgccagaaccaccactg

SEQ ID NO: 17229 - DNA, 24 bp, Homo sapiens
tgcgagctggatgagaacaacacc

SEQ ID NO: 17230 - DNA, 24 bp, Homo sapiens
gcagcaatgacaacaagaccttcg

SEQ ID NO: 17231 - DNA, 24 bp, Homo sapiens
ttccttgtcagaaagtggagctgt

SEQ ID NO: 17232 - DNA, 24 bp, Homo sapiens
tttccttgtcagaaagtggagctg

SEQ ID NO: 17233 - DNA, 24 bp, Homo sapiens
ttttccttgtcagaaagtggagct

SEQ ID NO: 17234 - DNA, 23 bp, Homo sapiens
gactcaccacaacctccgcctcc

SEQ ID NO: 17235 - DNA, 25 bp, Homo sapiens
gttggtcaggctggtcttgaactcc

SEQ ID NO: 17236 - DNA, 23 bp, Homo sapiens
gcaattctcctgcctcagcctcc

SEQ ID NO: 17237 - DNA, 24 bp, Homo sapiens
gccttgatctcctgacctcgtgat

SEQ ID NO: 17238 - DNA, 24 bp, Homo sapiens
tctctgtctcctgggttcaagcga

SEQ ID NO: 17239 - DNA, 24 bp, Homo sapiens
agacaccatgcccagcctcctatt

SEQ ID NO: 17240 - DNA, 24 bp, Homo sapiens
aaaagcaacagatgctggagaatc

SEQ ID NO: 17241 - DNA, 24 bp, Homo sapiens
aaaaagcaacagatgctggagaat

SEQ ID NO: 17242 - DNA, 24 bp, Homo sapiens
gaaaaagcaacagatgctggagaa

SEQ ID NO: 17243 - DNA, 24 bp, Homo sapiens
gagagaggctggtgagtggagacc

SEQ ID NO: 17244 - DNA, 24 bp, Homo sapiens
ggagagaggctggtgagtggagac

SEQ ID NO: 17245 - DNA, 24 bp, Homo sapiens
tggagagaggctggtgagtggaga

SEQ ID NO: 17246 - DNA, 24 bp, Homo sapiens
aggacgagatcttgtgggttggag

SEQ ID NO: 17247 - DNA, 24 bp, Homo sapiens
gaggacgagatcttgtgggttgga

SEQ ID NO: 17248 - DNA, 24 bp, Homo sapiens
ggaggacgagatcttgtgggttgg

SEQ ID NO: 17249 - DNA, 24 bp, Homo sapiens
agaaggccaaggatgagcagagtg

SEQ ID NO: 17250 - DNA, 24 bp, Homo sapiens
gagaaggccaaggatgagcagagt

SEQ ID NO: 17251 - DNA, 24 bp, Homo sapiens
ggagaaggccaaggatgagcagag

SEQ ID NO: 17252 - DNA, 24 bp, Homo sapiens
agaaggccaaggtgagaggaggcg

SEQ ID NO: 17253 - DNA, 24 bp, Homo sapiens
gagaaggccaaggtgagaggaggc

SEQ ID NO: 17254 - DNA, 24 bp, Homo sapiens
ggagaaggccaaggtgagaggagg

SEQ ID NO: 17255 - DNA, 24 bp, Homo sapiens
agcatgtcacgatgttacaagaac

SEQ ID NO: 17256 - DNA, 24 bp, Homo sapiens
gagcatgtcacgatgttacaagaa

SEQ ID NO: 17257 - DNA, 24 bp, Homo sapiens
tgagcatgtcacgatgttacaaga

SEQ ID NO: 17258 - DNA, 24 bp, Homo sapiens
catctgaggagatcaaggaaaaat

SEQ ID NO: 17259 - DNA, 24 bp, Homo sapiens
gcatctgaggagatcaaggaaaaa

SEQ ID NO: 17260 - DNA, 24 bp, Homo sapiens
tgcatctgaggagatcaaggaaaa

SEQ ID NO: 17261 - DNA, 24 bp, Homo sapiens
cagcagcagtgggatacttcaaaa

SEQ ID NO: 17262 - DNA, 24 bp, Homo sapiens
ccagcagcagtgggatacttcaaa

SEQ ID NO: 17263 - DNA, 24 bp, Homo sapiens
cccagcagcagtgggatacttcaa

SEQ ID NO: 17264 - DNA, 24 bp, Homo sapiens
ccaaagacgatgaggaaatgaaca

SEQ ID NO: 17265 - DNA, 24 bp, Homo sapiens
gccaaagacgatgaggaaatgaac

SEQ ID NO: 17266 - DNA, 24 bp, Homo sapiens
agccaaagacgatgaggaaatgaa

SEQ ID NO: 17267 - DNA, 24 bp, Homo sapiens
ggaccccgaagacatcagcgtgga

SEQ ID NO: 17268 - DNA, 24 bp, Homo sapiens
tggaccccgaagacatcagcgtgg

SEQ ID NO: 17269 - DNA, 24 bp, Homo sapiens
ttggaccccgaagacatcagcgtg

SEQ ID NO: 17270 - DNA, 24 bp, Homo sapiens
acatcaacaaggcctgggaaagac

SEQ ID NO: 17271 - DNA, 24 bp, Homo sapiens
gacatcaacaaggcctgggaaaga

SEQ ID NO: 17272 - DNA, 24 bp, Homo sapiens
tgacatcaacaaggcctgggaaag

SEQ ID NO: 17273 - DNA, 24 bp, Homo sapiens
ctgagagggaggtggtcgcagggt

SEQ ID NO: 17274 - DNA, 24 bp, Homo sapiens
gctgagagggaggtggtcgcaggg

SEQ ID NO: 17275 - DNA, 24 bp, Homo sapiens
cgctgagagggaggtggtcgcagg

SEQ ID NO: 17276 - DNA, 23 bp, Homo sapiens
ggacattcagatgccgccaccat

SEQ ID NO: 17277 - DNA, 25 bp, Homo sapiens
attcttgccgcttcctatgaactgc

SEQ ID NO: 17278 - DNA, 25 bp, Homo sapiens
acagtggagaccttacagagaatgc

SEQ ID NO: 17279 - DNA, 24 bp, Homo sapiens
gaggaagaggagaggaagaggcgg

SEQ ID NO: 17280 - DNA, 25 bp, Homo sapiens
ccgagcacgaaggtttcagaggaag

SEQ ID NO: 17281 - DNA, 24 bp, Homo sapiens
ccagcagcagtgggatacttcaaa

SEQ ID NO: 17282 - DNA, 23 bp, Homo sapiens
agagcgtggacgaggtggagaag

SEQ ID NO: 17283 - DNA, 23 bp, Homo sapiens
agccgtacctatccagccgagag

SEQ ID NO: 17284 - DNA, 25 bp, Homo sapiens
tcagttctcaagagacgccagtgtg

SEQ ID NO: 17285 - DNA, 23 bp, Homo sapiens
cgtaaagccaagactgccctccc

SEQ ID NO: 17286 - DNA, 23 bp, Homo sapiens
ccgccaccttaccagccagaacc

SEQ ID NO: 17287 - DNA, 25 bp, Homo sapiens
gcccacaataagaaagcctcaagca

SEQ ID NO: 17288 - DNA, 24 bp, Homo sapiens
cgtaatgacagtttcacaacctgc

SEQ ID NO: 17289 - DNA, 25 bp, Homo sapiens
cttgggaaatccctgttggcgagaa

SEQ ID NO: 17290 - DNA, 25 bp, Homo sapiens
aatcatcaaggcatcaaagctgaaa

SEQ ID NO: 17291 - DNA, 23 bp, Homo sapiens
agccgtacctatccagccgagag

SEQ ID NO: 17292 - DNA, 23 bp, Homo sapiens
agagcgtggacgaggtggagaag

SEQ ID NO: 17293 - DNA, 23 bp, Homo sapiens
tctcaagagacgccagtgtggcc

SEQ ID NO: 17294 - DNA, 24 bp, Homo sapiens
ctaaagagtccagccccatcccct

SEQ ID NO: 17295 - DNA, 23 bp, Homo sapiens
cgtaaagccaagactgccctccc

SEQ ID NO: 17296 - DNA, 23 bp, Homo sapiens
ccgccaccttaccagccagaacc

SEQ ID NO: 17297 - DNA, 25 bp, Homo sapiens
agcgaggtccctgtgagtttgaaag

SEQ ID NO: 17298 - DNA, 25 bp, Homo sapiens
gcccacaataagaaagcctcaagca

SEQ ID NO: 17299 - DNA, 23 bp, Homo sapiens
ccgccaccttaccagccagaacc

SEQ ID NO: 17300 - DNA, 24 bp, Homo sapiens
tgaccttcgagatggacggatgct

SEQ ID NO: 17301 - DNA, 23 bp, Homo sapiens
tcccaccttgcccgtgtgtcctg

SEQ ID NO: 17302 - DNA, 23 bp, Homo sapiens
agaagaagaccttcaccaagtgg

SEQ ID NO: 17303 - DNA, 25 bp, Homo sapiens
actgcttagagaatgtggacaaggc

SEQ ID NO: 17304 - DNA, 24 bp, Homo sapiens
gcctcatctggaccatcatcctgc

SEQ ID NO: 17305 - DNA, 25 bp, Homo sapiens
tgttgtggtgccagatgaagacagc

SEQ ID NO: 17306 - DNA, 25 bp, Homo sapiens
tgttgtggtgccagatgaagacagc

SEQ ID NO: 17307 - DNA, 25 bp, Homo sapiens
ttaatctggcagaacagcacctcgg

SEQ ID NO: 17308 - DNA, 24 bp, Homo sapiens
ccgaagacatcagcgtggaccatc

SEQ ID NO: 17309 - DNA, 25 bp, Homo sapiens
ttaatctggcagaacagcacctcgg

SEQ ID NO: 17310 - DNA, 24 bp, Homo sapiens
ccgaagacatcagcgtggaccatc

SEQ ID NO: 17311 - DNA, 25 bp, Homo sapiens
acttgcctctgaccttctggaatgg

SEQ ID NO: 17312 - DNA, 25 bp, Homo sapiens
ttaatctggcagaacagcacctcgg

SEQ ID NO: 17313 - DNA, 25 bp, Homo sapiens
tgttgtggtgccagatgaagacagc

SEQ ID NO: 17314 - DNA, 24 bp, Homo sapiens
gcctcatctggaccatcatcctgc

SEQ ID NO: 17315 - DNA, 25 bp, Homo sapiens
cttcaccattcagagcaagatgagg

SEQ ID NO: 17316 - DNA, 24 bp, Homo sapiens
gctcatctctgacatcaacaaggc

SEQ ID NO: 17317 - DNA, 24 bp, Homo sapiens
agcggaacacgaaagagaactggc

SEQ ID NO: 17318 - DNA, 25 bp, Homo sapiens
gcttcaggcattcaacacttaccgc

SEQ ID NO: 17319 - DNA, 25 bp, Homo sapiens
accatcatcattctgaacaatcgca

SEQ ID NO: 17320 - DNA, 25 bp, Homo sapiens
acttgcctctgaccttctggaatgg

SEQ ID NO: 17321 - DNA, 24 bp, Homo sapiens
gcggaacacgaaagagaactggct

SEQ ID NO: 17322 - DNA, 23 bp, Homo sapiens
gccattgagacagacattgccgc

SEQ ID NO: 17323 - DNA, 25 bp, Homo sapiens
gccgagaattaccacgacatcaagc

SEQ ID NO: 17324 - DNA, 24 bp, Homo sapiens
gcggaacacgaaagagaactggct

SEQ ID NO: 17325 - DNA, 25 bp, Homo sapiens
tatgagggagacttggctgagcgaa

SEQ ID NO: 17326 - DNA, 23 bp, Homo sapiens
ctcgcccgcagatttgatcgcaa

SEQ ID NO: 17327 - DNA, 25 bp, Homo sapiens
cttcaccattcagagcaagatgagg

SEQ ID NO: 17328 - DNA, 25 bp, Homo sapiens
gcttcaggcattcaacacttaccgc

SEQ ID NO: 17329 - DNA, 25 bp, Homo sapiens
accatcatcattctgaacaatcgca

SEQ ID NO: 17330 - DNA, 23 bp, Homo sapiens
gccattgagacagacattgccgc

SEQ ID NO: 17331 - DNA, 25 bp, Homo sapiens
gccgagaattaccacgacatcaagc

SEQ ID NO: 17332 - DNA, 25 bp, Homo sapiens
cggctctgggaatacctactggaac

SEQ ID NO: 17333 - DNA, 23 bp, Homo sapiens
gtgtcaatgcctccgcccagaag

SEQ ID NO: 17334 - DNA, 24 bp, Homo sapiens
tggttgaagcagacattggcatcc

SEQ ID NO: 17335 - DNA, 25 bp, Homo sapiens
cggctctgggaatacctactggaac

SEQ ID NO: 17336 - DNA, 24 bp, Homo sapiens
agaaatgaacaaccaggcttcccg

SEQ ID NO: 17337 - DNA, 25 bp, Homo sapiens
gtgagaaggaaatcaaagcccagca

SEQ ID NO: 17338 - DNA, 23 bp, Homo sapiens
gtgaaccagattgcacgccagct

SEQ ID NO: 17339 - DNA, 23 bp, Homo sapiens
gatcgacgagaaggagcagtggc

SEQ ID NO: 17340 - DNA, 23 bp, Homo sapiens
aagcaggcactccaggacactct

SEQ ID NO: 17341 - DNA, 24 bp, Homo sapiens
gaggagcggtataaggaggtggca

SEQ ID NO: 17342 - DNA, 24 bp, Homo sapiens
tgagacggaagctgtggtgaagga

SEQ ID NO: 17343 - DNA, 25 bp, Homo sapiens
tcagatggaagtgcggaagaaggag

SEQ ID NO: 17344 - DNA, 23 bp, Homo sapiens
agcaccgacgaggtagacagcaa

SEQ ID NO: 17345 - DNA, 23 bp, Homo sapiens
agcaccgacgaggtagacagcaa

SEQ ID NO: 17346 - DNA, 24 bp, Homo sapiens
caagttcatggagttgctggagcc

SEQ ID NO: 17347 - DNA, 24 bp, Homo sapiens
cttgtgggttggagagaggatgcc

SEQ ID NO: 17348 - DNA, 24 bp, Homo sapiens
caagttcatggagttgctggagcc

SEQ ID NO: 17349 - DNA, 23 bp, Homo sapiens
agcaccgacgaggtagacagcaa

SEQ ID NO: 17350 - DNA, 25 bp, Homo sapiens
gtgcggaagaaggagatcgaagagc

SEQ ID NO: 17351 - DNA, 23 bp, Homo sapiens
gcctttggcaacttccacggatc

SEQ ID NO: 17352 - DNA, 23 bp, Homo sapiens
acaacctccagactgtgcagctg

SEQ ID NO: 17353 - DNA, 24 bp, Homo sapiens
caagttcatggagttgctggagcc

SEQ ID NO: 17354 - DNA, 23 bp, Homo sapiens
agcaccgacgaggtagacagcaa

SEQ ID NO: 17355 - DNA, 25 bp, Homo sapiens
tcagatggaagtgcggaagaaggag

SEQ ID NO: 17356 - DNA, 25 bp, Homo sapiens
agagaagaggcaagctggatgagag

SEQ ID NO: 17357 - DNA, 23 bp, Homo sapiens
cctggagcagtggatcgctgaga

SEQ ID NO: 17358 - DNA, 25 bp, Homo sapiens
gtggataaactgtacgctggtctga

SEQ ID NO: 17359 - DNA, 24 bp, Homo sapiens
cgtaatgacagtttcacaacctgc

SEQ ID NO: 17360 - DNA, 25 bp, Homo sapiens
cttgggaaatccctgttggcgagaa

SEQ ID NO: 17361 - DNA, 25 bp, Homo sapiens
tgaataatcatcaaggcatcaaagc

SEQ ID NO: 17362 - DNA, 24 bp, Homo sapiens
gaggaagaggagaggaagaggcgg

SEQ ID NO: 17363 - DNA, 23 bp, Homo sapiens
cacaagcgaaatggtcaacggcg

SEQ ID NO: 17364 - DNA, 23 bp, Homo sapiens
cgtaaagccaagactgccctccc

SEQ ID NO: 17365 - DNA, 24 bp, Homo sapiens
gaggaagaggagaggaagaggcgg

SEQ ID NO: 17366 - DNA, 25 bp, Homo sapiens
ccgagcacgaaggtttcagaggaag

SEQ ID NO: 17367 - DNA, 24 bp, Homo sapiens
gaggaagaggagaggaagaggcgg

SEQ ID NO: 17368 - DNA, 25 bp, Homo sapiens
ggctgactacattggagttactgga

SEQ ID NO: 17369 - DNA, 23 bp, Homo sapiens
agagcgtggacgaggtggagaag

SEQ ID NO: 17370 - DNA, 25 bp, Homo sapiens
gcaatgagtacctcttccaagccaa

SEQ ID NO: 17371 - DNA, 25 bp, Homo sapiens
gctatctcttccgccatctcctctg

SEQ ID NO: 17372 - DNA, 23 bp, Homo sapiens
ccagagcacgccagcatccagcc

SEQ ID NO: 17373 - DNA, 24 bp, Homo sapiens
ggttcaagcgattctcctgcctca

SEQ ID NO: 17374 - DNA, 23 bp, Homo sapiens
gtgcagtggtgtgatctcggctc

SEQ ID NO: 17375 - DNA, 24 bp, Homo sapiens
agagcgagcagttcctgacggagc

SEQ ID NO: 17376 - DNA, 24 bp, Homo sapiens
gagagcgagcagttcctgacggag

SEQ ID NO: 17377 - DNA, 24 bp, Homo sapiens
ggagagcgagcagttcctgacgga

SEQ ID NO: 17378 - DNA, 24 bp, Homo sapiens
tcgagatgaaggtgagtcccctta

SEQ ID NO: 17379 - DNA, 24 bp, Homo sapiens
ctcgagatgaaggtgagtcccctt

SEQ ID NO: 17380 - DNA, 24 bp, Homo sapiens
actcgagatgaaggtgagtcccct

SEQ ID NO: 17381 - DNA, 24 bp, Homo sapiens
cctgtgaagatgaacaagagcaag

SEQ ID NO: 17382 - DNA, 24 bp, Homo sapiens
gatcctctcaccaccttggcctcc

SEQ ID NO: 17383 - DNA, 24 bp, Homo sapiens
aaccaggctggtcttgaactcctg

SEQ ID NO: 17384 - DNA, 25 bp, Homo sapiens
ctgaagccctggagcctctttgatg

SEQ ID NO: 17385 - DNA, 24 bp, Homo sapiens
acaacaggattagaggaggcggct

SEQ ID NO: 17386 - DNA, 25 bp, Homo sapiens
agaagaggcaggctgagttattgga

SEQ ID NO: 17387 - DNA, 25 bp, Homo sapiens
gcaggagatagaagaattggagcga

SEQ ID NO: 17388 - DNA, 24 bp, Homo sapiens
cattgcttttgcacgtaaccaagg

SEQ ID NO: 17389 - DNA, 24 bp, Homo sapiens
ccattgcttttgcacgtaaccaag

SEQ ID NO: 17390 - DNA, 24 bp, Homo sapiens
gccattgcttttgcacgtaaccaa

SEQ ID NO: 17391 - DNA, 24 bp, Homo sapiens
acatcacaagcaaacccatcgtct

SEQ ID NO: 17392 - DNA, 24 bp, Homo sapiens
cctactgtgacctacgcagcctca

SEQ ID NO: 17393 - DNA, 24 bp, Homo sapiens
gctgtggtggctgccctcatgaag

SEQ ID NO: 17394 - DNA, 24 bp, Homo sapiens
gtaccgcacagagatccaacagca

SEQ ID NO: 17395 - DNA, 24 bp, Homo sapiens
aatgacttcctgcggctccttcgt

SEQ ID NO: 17396 - DNA, 24 bp, Homo sapiens
gtgaggtccatgattgagacacgg

SEQ ID NO: 17397 - DNA, 24 bp, Homo sapiens
acatcacaagcaaacccatcgtct

SEQ ID NO: 17398 - DNA, 24 bp, Homo sapiens
cctactgtgacctacgcagcctca

SEQ ID NO: 17399 - DNA, 24 bp, Homo sapiens
gcccaataccaaatcgccgctttc

SEQ ID NO: 17400 - DNA, 24 bp, Homo sapiens
gcaagaatgaggtgacactggaat

SEQ ID NO: 17401 - DNA, 24 bp, Homo sapiens
gcttctacgtcccacccacccagg

SEQ ID NO: 17402 - DNA, 24 bp, Homo sapiens
acattggtgaccagccagtctttg

SEQ ID NO: 17403 - DNA, 24 bp, Homo sapiens
cctggcatcagcatcacggatctt

SEQ ID NO: 17404 - DNA, 24 bp, Homo sapiens
tgccagccgagagaagatcaagtc

SEQ ID NO: 17405 - DNA, 24 bp, Homo sapiens
cccaagaggcccatgtctgcatac

SEQ ID NO: 17406 - DNA, 24 bp, Homo sapiens
tgggtggagagcatgggtggtaaa

SEQ ID NO: 17407 - DNA, 24 bp, Homo sapiens
gtgggtggagagcatgggtggtaa

SEQ ID NO: 17408 - DNA, 24 bp, Homo sapiens
agtgggtggagagcatgggtggta

SEQ ID NO: 17409 - DNA, 24 bp, Homo sapiens
aatgctgccatccgagactgtgac

SEQ ID NO: 17410 - DNA, 24 bp, Homo sapiens
ggaagaagccagacgacagtcagg

SEQ ID NO: 17411 - DNA, 24 bp, Homo sapiens
tcttgcccttgcctgtaaattgga

SEQ ID NO: 17412 - DNA, 24 bp, Homo sapiens
ccttctgataaataaagcccttgc

SEQ ID NO: 17413 - DNA, 24 bp, Homo sapiens
cctagatcaccttatggatgtcgc

SEQ ID NO: 17414 - DNA, 24 bp, Homo sapiens
accagtgtacctctgaccttctca

SEQ ID NO: 17415 - DNA, 24 bp, Homo sapiens
aggcagacgaaccatcaagtgagg

SEQ ID NO: 17416 - DNA, 24 bp, Homo sapiens
tgaaccagacactgatgctcctca

SEQ ID NO: 17417 - DNA, 24 bp, Homo sapiens
atgcggagataacggaggagatga

SEQ ID NO: 17418 - DNA, 24 bp, Homo sapiens
tggaggaagacttaaaggcagacg

SEQ ID NO: 17419 - DNA, 24 bp, Homo sapiens
gccattgacttattcacagatgcc

SEQ ID NO: 17420 - DNA, 24 bp, Homo sapiens
aatgctgccatccgagactgtgac

SEQ ID NO: 17421 - DNA, 24 bp, Homo sapiens
gggaaagcacacagacttctaggc

SEQ ID NO: 17422 - DNA, 24 bp, Homo sapiens
ggtttgtgtaggtctgcaggaagg

SEQ ID NO: 17423 - DNA, 24 bp, Homo sapiens
gggtttgtgtaggtctgcaggaag

SEQ ID NO: 17424 - DNA, 24 bp, Homo sapiens
tgggtttgtgtaggtctgcaggaa

SEQ ID NO: 17425 - DNA, 24 bp, Homo sapiens
gacaactcaagacgcctgcccatc

SEQ ID NO: 17426 - DNA, 24 bp, Homo sapiens
ctctctcggaccaggagggctacc

SEQ ID NO: 17427 - DNA, 24 bp, Homo sapiens
aacccttttgccttctccagccag

SEQ ID NO: 17428 - DNA, 24 bp, Homo sapiens
tttttaaataggttgctggtcaaa

SEQ ID NO: 17429 - DNA, 24 bp, Homo sapiens
ctttttaaataggttgctggtcaa

SEQ ID NO: 17430 - DNA, 24 bp, Homo sapiens
tctttttaaataggttgctggtca

SEQ ID NO: 17431 - DNA, 24 bp, Homo sapiens
aattttgcaaagaaaacatggctg

SEQ ID NO: 17432 - DNA, 24 bp, Homo sapiens
aaattttgcaaagaaaacatggct

SEQ ID NO: 17433 - DNA, 24 bp, Homo sapiens
taaattttgcaaagaaaacatggc

SEQ ID NO: 17434 - DNA, 24 bp, Homo sapiens
ggacatcagcggtaagacccagat

SEQ ID NO: 17435 - DNA, 24 bp, Homo sapiens
aggacatcagcggtaagacccaga

SEQ ID NO: 17436 - DNA, 24 bp, Homo sapiens
aaggacatcagcggtaagacccag

SEQ ID NO: 17437 - DNA, 24 bp, Homo sapiens
tgacccaggtagcgctgccccata

SEQ ID NO: 17438 - DNA, 24 bp, Homo sapiens
ctgacccaggtagcgctgccccat

SEQ ID NO: 17439 - DNA, 24 bp, Homo sapiens
gctgacccaggtagcgctgcccca

SEQ ID NO: 17440 - DNA, 24 bp, Homo sapiens
atttcctacagaacgacctgcagc

SEQ ID NO: 17441 - DNA, 24 bp, Homo sapiens
catttcctacagaacgacctgcag

SEQ ID NO: 17442 - DNA, 24 bp, Homo sapiens
ccatttcctacagaacgacctgca

SEQ ID NO: 17443 - DNA, 24 bp, Homo sapiens
agtttcttcagagcaggtatcttg

SEQ ID NO: 17444 - DNA, 24 bp, Homo sapiens
cagtttcttcagagcaggtatctt

SEQ ID NO: 17445 - DNA, 24 bp, Homo sapiens
gcagtttcttcagagcaggtatct

SEQ ID NO: 17446 - DNA, 24 bp, Homo sapiens
ccgcactttagattcattgatgca

SEQ ID NO: 17447 - DNA, 24 bp, Homo sapiens
cccgcactttagattcattgatgc

SEQ ID NO: 17448 - DNA, 24 bp, Homo sapiens
ccccgcactttagattcattgatg

SEQ ID NO: 17449 - DNA, 24 bp, Homo sapiens
tgtgtgacaccattcattgatgca

SEQ ID NO: 17450 - DNA, 24 bp, Homo sapiens
ctgtgtgacaccattcattgatgc

SEQ ID NO: 17451 - DNA, 24 bp, Homo sapiens
tctgtgtgacaccattcattgatg

SEQ ID NO: 17452 - DNA, 23 bp, Homo sapiens
gaatcacgccttctacagactgc

SEQ ID NO: 17453 - DNA, 25 bp, Homo sapiens
tcagagcaggtatcttgagaagcca

SEQ ID NO: 17454 - DNA, 25 bp, Homo sapiens
agcacaatctacgaagaatcaagca

SEQ ID NO: 17455 - DNA, 24 bp, Homo sapiens
attcagggtgtcagatcacatggg

SEQ ID NO: 17456 - DNA, 25 bp, Homo sapiens
agagattgaccagcagtatagccgc

SEQ ID NO: 17457 - DNA, 25 bp, Homo sapiens
agcacaatctacgaagaatcaagca

SEQ ID NO: 17458 - DNA, 25 bp, Homo sapiens
tcagagcaggtatcttgagaagcca

SEQ ID NO: 17459 - DNA, 25 bp, Homo sapiens
agagattgaccagcagtatagccgc

SEQ ID NO: 17460 - DNA, 25 bp, Homo sapiens
tctctatcagcacaatctacgaaga

SEQ ID NO: 17461 - DNA, 25 bp, Homo sapiens
atgccactttggtgtttcataatct

SEQ ID NO: 17462 - DNA, 23 bp, Homo sapiens
atggagctgcggcagtttctggc

SEQ ID NO: 17463 - DNA, 25 bp, Homo sapiens
gctccatcagctctacagtgacagc

SEQ ID NO: 17464 - DNA, 23 bp, Homo sapiens
ccaatggaatcagctacagcagc

SEQ ID NO: 17465 - DNA, 23 bp, Homo sapiens
gaatcacgccttctacagactgc

SEQ ID NO: 17466 - DNA, 23 bp, Homo sapiens
gcggagaagcatcgtgagtgagc

SEQ ID NO: 17467 - DNA, 23 bp, Homo sapiens
gctgactggaagaggcggcaaca

SEQ ID NO: 17468 - DNA, 24 bp, Homo sapiens
gtggtgacggagaagcagcagatg

SEQ ID NO: 17469 - DNA, 23 bp, Homo sapiens
gcggagaagcatcgtgagtgagc

SEQ ID NO: 17470 - DNA, 23 bp, Homo sapiens
gctgactggaagaggcggcaaca

SEQ ID NO: 17471 - DNA, 23 bp, Homo sapiens
cagcagccgtggtgacggagaag

SEQ ID NO: 17472 - DNA, 23 bp, Homo sapiens
atgctggagcagcaccttcagga

SEQ ID NO: 17473 - DNA, 24 bp, Homo sapiens
ggacgttgcagctctcagaggatc

SEQ ID NO: 17474 - DNA, 24 bp, Homo sapiens
gaagaatccaacaacggcagcctc

SEQ ID NO: 17475 - DNA, 25 bp, Homo sapiens
ctccttgccagttgtggtgatctcc

SEQ ID NO: 17476 - DNA, 25 bp, Homo sapiens
gccatcttgagcactaagcctccag

SEQ ID NO: 17477 - DNA, 23 bp, Homo sapiens
agcagcaaagaaggaggcgtcac

SEQ ID NO: 17478 - DNA, 25 bp, Homo sapiens
ggtggagaaggacatcagcggtaag

SEQ ID NO: 17479 - DNA, 25 bp, Homo sapiens
gccatcttgagcactaagcctccag

SEQ ID NO: 17480 - DNA, 25 bp, Homo sapiens
ggtggagaaggacatcagcggtaag

SEQ ID NO: 17481 - DNA, 23 bp, Homo sapiens
ccagtccgtggaaccatacacaa

SEQ ID NO: 17482 - DNA, 25 bp, Homo sapiens
tgtctccactggtctatctctatcc

SEQ ID NO: 17483 - DNA, 23 bp, Homo sapiens
cccaaggaggaggcattcggaaa

SEQ ID NO: 17484 - DNA, 23 bp, Homo sapiens
ggaaccatacacaaagcagcagc

SEQ ID NO: 17485 - DNA, 24 bp, Homo sapiens
aataccattgacctgccgatgtcc

SEQ ID NO: 17486 - DNA, 23 bp, Homo sapiens
tcagcaggagggcagtttgagtc

SEQ ID NO: 17487 - DNA, 25 bp, Homo sapiens
ccatgtgaggagctgagaacggaag

SEQ ID NO: 17488 - DNA, 25 bp, Homo sapiens
tcctggtgtctccactggtctatct

SEQ ID NO: 17489 - DNA, 23 bp, Homo sapiens
ccagtccgtggaaccatacacaa

SEQ ID NO: 17490 - DNA, 25 bp, Homo sapiens
ggtggagaaggacatcagcggtaag

SEQ ID NO: 17491 - DNA, 24 bp, Homo sapiens
tctccccagaagaatcagtcaacg

SEQ ID NO: 17492 - DNA, 24 bp, Homo sapiens
cactctcactccatccccccgtat

SEQ ID NO: 17493 - DNA, 24 bp, Homo sapiens
gcagcagccagagtttattaacca

SEQ ID NO: 17494 - DNA, 24 bp, Homo sapiens
agcagcagccagagtttattaacc

SEQ ID NO: 17495 - DNA, 24 bp, Homo sapiens
gagcagcagccagagtttattaac

SEQ ID NO: 17496 - DNA, 24 bp, Homo sapiens
tgaatttcgaggtggcccgggaga

SEQ ID NO: 17497 - DNA, 24 bp, Homo sapiens
gtgaatttcgaggtggcccgggag

SEQ ID NO: 17498 - DNA, 24 bp, Homo sapiens
tgtgaatttcgaggtggcccggga

SEQ ID NO: 17499 - DNA, 24 bp, Homo sapiens
ccatagtcaagccacagacaagcc

SEQ ID NO: 17500 - DNA, 24 bp, Homo sapiens
cccatagtcaagccacagacaagc

SEQ ID NO: 17501 - DNA, 24 bp, Homo sapiens
acccatagtcaagccacagacaag

SEQ ID NO: 17502 - DNA, 24 bp, Homo sapiens
ttgtgatgcaggtgaaggttggaa

SEQ ID NO: 17503 - DNA, 24 bp, Homo sapiens
tttgtgatgcaggtgaaggttgga

SEQ ID NO: 17504 - DNA, 24 bp, Homo sapiens
gtttgtgatgcaggtgaaggttgg

SEQ ID NO: 17505 - DNA, 24 bp, Homo sapiens
gccgccatagctgttcttgaggag

SEQ ID NO: 17506 - DNA, 24 bp, Homo sapiens
ccatagtcaagccacagacaagcc

SEQ ID NO: 17507 - DNA, 24 bp, Homo sapiens
ggatcaatccgattagccgactgg

SEQ ID NO: 17508 - DNA, 25 bp, Homo sapiens
ccgagaacatgctggagatccttgg

SEQ ID NO: 17509 - DNA, 24 bp, Homo sapiens
ccgcactcaagtcagaggagaaga

SEQ ID NO: 17510 - DNA, 24 bp, Homo sapiens
aagaggatgagttcaggatgcctt

SEQ ID NO: 17511 - DNA, 24 bp, Homo sapiens
cttggagaagggtcctatggcagc

SEQ ID NO: 17512 - DNA, 24 bp, Homo sapiens
acttggagaagggtcctatggcag

SEQ ID NO: 17513 - DNA, 24 bp, Homo sapiens
aacttggagaagggtcctatggca

SEQ ID NO: 17514 - DNA, 24 bp, Homo sapiens
gtcaacttacagataccatggcca

SEQ ID NO: 17515 - DNA, 24 bp, Homo sapiens
ggtcaacttacagataccatggcc

SEQ ID NO: 17516 - DNA, 24 bp, Homo sapiens
aggtcaacttacagataccatggc

SEQ ID NO: 17517 - DNA, 24 bp, Homo sapiens
gagttttaaaccccaggaacagag

SEQ ID NO: 17518 - DNA, 24 bp, Homo sapiens
agagttttaaaccccaggaacaga

SEQ ID NO: 17519 - DNA, 24 bp, Homo sapiens
cagagttttaaaccccaggaacag

SEQ ID NO: 17520 - DNA, 24 bp, Homo sapiens
cgcctcggcctcccagcttgtcag

SEQ ID NO: 17521 - DNA, 24 bp, Homo sapiens
ccgcctcggcctcccagcttgtca

SEQ ID NO: 17522 - DNA, 24 bp, Homo sapiens
cccgcctcggcctcccagcttgtc

SEQ ID NO: 17523 - DNA, 24 bp, Homo sapiens
actatgattgagcacgatgacacg

SEQ ID NO: 17524 - DNA, 24 bp, Homo sapiens
gcagaggatgaggaagaggaagga

SEQ ID NO: 17525 - DNA, 24 bp, Homo sapiens
agttggacagtggaggaccttcag

SEQ ID NO: 17526 - DNA, 24 bp, Homo sapiens
cactgtccgagtagccagcaccat

SEQ ID NO: 17527 - DNA, 24 bp, Homo sapiens
actatgattgagcacgatgacacg

SEQ ID NO: 17528 - DNA, 24 bp, Homo sapiens
gatggttcgagcagtgggtgatga

SEQ ID NO: 17529 - DNA, 24 bp, Homo sapiens
agttggacagtggaggaccttcag

SEQ ID NO: 17530 - DNA, 24 bp, Homo sapiens
tgatggagcaggagattgaagaga

SEQ ID NO: 17531 - DNA, 24 bp, Homo sapiens
agaagtaccagtccaagcggcagc

SEQ ID NO: 17532 - DNA, 24 bp, Homo sapiens
ttggcaagagtgtacctggtccac

SEQ ID NO: 17533 - DNA, 24 bp, Homo sapiens
agcctgcgaaaccatcctttcttg

SEQ ID NO: 17534 - DNA, 24 bp, Homo sapiens
tcttcagattggaaaataccacag

SEQ ID NO: 17535 - DNA, 24 bp, Homo sapiens
tgatggagcaggagattgaagaga

SEQ ID NO: 17536 - DNA, 24 bp, Homo sapiens
agaagtaccagtccaagcggcagc

SEQ ID NO: 17537 - DNA, 24 bp, Homo sapiens
agaggctaagaagagacggcaaca

SEQ ID NO: 17538 - DNA, 24 bp, Homo sapiens
agatcaagcagttctcccagcagg

SEQ ID NO: 17539 - DNA, 24 bp, Homo sapiens
aagatcaagcagttctcccagcag

SEQ ID NO: 17540 - DNA, 24 bp, Homo sapiens
gaagatcaagcagttctcccagca

SEQ ID NO: 17541 - DNA, 24 bp, Homo sapiens
gccgcctgcagcccgtgtccagga

SEQ ID NO: 17542 - DNA, 24 bp, Homo sapiens
ggccgcctgcagcccgtgtccagg

SEQ ID NO: 17543 - DNA, 24 bp, Homo sapiens
tggccgcctgcagcccgtgtccag

SEQ ID NO: 17544 - DNA, 24 bp, Homo sapiens
agccccggccggcctccccagggt

SEQ ID NO: 17545 - DNA, 24 bp, Homo sapiens
aagccccggccggcctccccaggg

SEQ ID NO: 17546 - DNA, 24 bp, Homo sapiens
aaagccccggccggcctccccagg

SEQ ID NO: 17547 - DNA, 24 bp, Homo sapiens
ccacggacaaggcgaacatcaaag

SEQ ID NO: 17548 - DNA, 24 bp, Homo sapiens
accacggacaaggcgaacatcaaa

SEQ ID NO: 17549 - DNA, 24 bp, Homo sapiens
gaccacggacaaggcgaacatcaa

SEQ ID NO: 17550 - DNA, 24 bp, Homo sapiens
gggcatcaccattgttgaagacat

SEQ ID NO: 17551 - DNA, 24 bp, Homo sapiens
agggcatcaccattgttgaagaca

SEQ ID NO: 17552 - DNA, 24 bp, Homo sapiens
gagggcatcaccattgttgaagac

SEQ ID NO: 17553 - DNA, 24 bp, Homo sapiens
cttcaccgacacctgccccgagcc

SEQ ID NO: 17554 - DNA, 24 bp, Homo sapiens
tcttcaccgacacctgccccgagc

SEQ ID NO: 17555 - DNA, 24 bp, Homo sapiens
ttcttcaccgacacctgccccgag

SEQ ID NO: 17556 - DNA, 24 bp, Homo sapiens
tttgggcggaactggctttgttga

SEQ ID NO: 17557 - DNA, 24 bp, Homo sapiens
ctgagccccacggagaagtcggtt

SEQ ID NO: 17558 - DNA, 24 bp, Homo sapiens
gggaccccgactttcacctacaaa

SEQ ID NO: 17559 - DNA, 24 bp, Homo sapiens
ggaacccattcccagtctggaggc

SEQ ID NO: 17560 - DNA, 24 bp, Homo sapiens
ctctcgtctggcaaaggtggtgaa

SEQ ID NO: 17561 - DNA, 24 bp, Homo sapiens
agattcaccttgccttcctcccct

SEQ ID NO: 17562 - DNA, 24 bp, Homo sapiens
ccacagcacctacaacctctactg

SEQ ID NO: 17563 - DNA, 24 bp, Homo sapiens
gggaccccgactttcacctacaaa

SEQ ID NO: 17564 - DNA, 24 bp, Homo sapiens
aagatgccgcagtaccagaaggag

SEQ ID NO: 17565 - DNA, 24 bp, Homo sapiens
gaccacggacaaggcgaacatcaa

SEQ ID NO: 17566 - DNA, 24 bp, Homo sapiens
cctgaggaccttctgtgagagcaa

SEQ ID NO: 17567 - DNA, 24 bp, Homo sapiens
cgcatcttgtcttcctgctgcaaa

SEQ ID NO: 17568 - DNA, 23 bp, Homo sapiens
aatccacctgcctcaacctccca

SEQ ID NO: 17569 - DNA, 23 bp, Homo sapiens
ttgcccaggctggtctcaaactc

SEQ ID NO: 17570 - DNA, 24 bp, Homo sapiens
cagctccacggaggccctcatgaa

SEQ ID NO: 17571 - DNA, 24 bp, Homo sapiens
ccagctccacggaggccctcatga

SEQ ID NO: 17572 - DNA, 24 bp, Homo sapiens
tccagctccacggaggccctcatg

SEQ ID NO: 17573 - DNA, 24 bp, Homo sapiens
attgaggagagagtaggatgctga

SEQ ID NO: 17574 - DNA, 24 bp, Homo sapiens
tacccgtggcccaggtctgtgcct

SEQ ID NO: 17575 - DNA, 24 bp, Homo sapiens
agggatttgggttggtggattaac

SEQ ID NO: 17576 - DNA, 24 bp, Homo sapiens
gagggatttgggttggtggattaa

SEQ ID NO: 17577 - DNA, 24 bp, Homo sapiens
ggagggatttgggttggtggatta

SEQ ID NO: 17578 - DNA, 23 bp, Homo sapiens
ggcgagactcctccttcactgaa

SEQ ID NO: 17579 - DNA, 23 bp, Homo sapiens
cggaggtgctgctgaacatagaa

SEQ ID NO: 17580 - DNA, 24 bp, Homo sapiens
aacaggaagagtcaagcagagatg

SEQ ID NO: 17581 - DNA, 24 bp, Homo sapiens
agcgcgcggagattctggctacat

SEQ ID NO: 17582 - DNA, 24 bp, Homo sapiens
gagcgcgcggagattctggctaca

SEQ ID NO: 17583 - DNA, 24 bp, Homo sapiens
ggagcgcgcggagattctggctac

SEQ ID NO: 17584 - DNA, 23 bp, Homo sapiens
ggcgagactcctccttcactgaa

SEQ ID NO: 17585 - DNA, 23 bp, Homo sapiens
acgaggtcaagagctgagtgcca

SEQ ID NO: 17586 - DNA, 23 bp, Homo sapiens
cggaggtgctgctgaacatagaa

SEQ ID NO: 17587 - DNA, 25 bp, Homo sapiens
aagagaaggtggaggtggagaatgt

SEQ ID NO: 17588 - DNA, 25 bp, Homo sapiens
ggaaggagacagccataaggaatct

SEQ ID NO: 17589 - DNA, 25 bp, Homo sapiens
tggtagagggtagcgagaacaaggg

SEQ ID NO: 17590 - DNA, 24 bp, Homo sapiens
actactacaaggcccagacccatg

SEQ ID NO: 17591 - DNA, 24 bp, Homo sapiens
aactactacaaggcccagacccat

SEQ ID NO: 17592 - DNA, 24 bp, Homo sapiens
aaactactacaaggcccagaccca

SEQ ID NO: 17593 - DNA, 24 bp, Homo sapiens
gccatcatcagtcagaagcctcag

SEQ ID NO: 17594 - DNA, 24 bp, Homo sapiens
ctgatcgctaccacagcccatgaa

SEQ ID NO: 17595 - DNA, 24 bp, Homo sapiens
agcaaattgtcctgataggatcaa

SEQ ID NO: 17596 - DNA, 24 bp, Homo sapiens
acacgcctcagcctcctgatttgt

SEQ ID NO: 17597 - DNA, 24 bp, Homo sapiens
tacacgcctcagcctcctgatttg

SEQ ID NO: 17598 - DNA, 24 bp, Homo sapiens
ctacacgcctcagcctcctgattt

SEQ ID NO: 17599 - DNA, 23 bp, Homo sapiens
ttacaggcacgcatcaccacacc

SEQ ID NO: 17600 - DNA, 24 bp, Homo sapiens
cgattcttgtgcctcagcctcctc

SEQ ID NO: 17601 - DNA, 23 bp, Homo sapiens
gtgcagtggtgtgatctcggctc

SEQ ID NO: 17602 - DNA, 24 bp, Homo sapiens
ccacccagcaggtcctgtccctca

SEQ ID NO: 17603 - DNA, 24 bp, Homo sapiens
tccacccagcaggtcctgtccctc

SEQ ID NO: 17604 - DNA, 24 bp, Homo sapiens
atccacccagcaggtcctgtccct

SEQ ID NO: 17605 - DNA, 24 bp, Homo sapiens
tgtatccacagttgctggaagtgc

SEQ ID NO: 17606 - DNA, 24 bp, Homo sapiens
atgtatccacagttgctggaagtg

SEQ ID NO: 17607 - DNA, 24 bp, Homo sapiens
catgtatccacagttgctggaagt

SEQ ID NO: 17608 - DNA, 24 bp, Homo sapiens
ggaccactagtgtgagcacctgaa

SEQ ID NO: 17609 - DNA, 24 bp, Homo sapiens
tggaccactagtgtgagcacctga

SEQ ID NO: 17610 - DNA, 24 bp, Homo sapiens
ctggaccactagtgtgagcacctg

SEQ ID NO: 17611 - DNA, 24 bp, Homo sapiens
cctccctctaggtactgctctcca

SEQ ID NO: 17612 - DNA, 24 bp, Homo sapiens
acctccctctaggtactgctctcc

SEQ ID NO: 17613 - DNA, 24 bp, Homo sapiens
tacctccctctaggtactgctctc

SEQ ID NO: 17614 - DNA, 23 bp, Homo sapiens
aagtcggctgtggagatgcggaa

SEQ ID NO: 17615 - DNA, 25 bp, Homo sapiens
ccttgcttgctgccttctggattct

SEQ ID NO: 17616 - DNA, 24 bp, Homo sapiens
gctcctccgtgcttcctcagttac

SEQ ID NO: 17617 - DNA, 24 bp, Homo sapiens
aagtgctggcattacaggcgtgag

SEQ ID NO: 17618 - DNA, 24 bp, Homo sapiens
tcaggtgatccacccgcttcagct

SEQ ID NO: 17619 - DNA, 24 bp, Homo sapiens
ctcaggtgatccacccgcttcagc

SEQ ID NO: 17620 - DNA, 24 bp, Homo sapiens
cctcaggtgatccacccgcttcag

SEQ ID NO: 17621 - DNA, 24 bp, Homo sapiens
gaagcccccaggccgccttccagg

SEQ ID NO: 17622 - DNA, 24 bp, Homo sapiens
ggaagcccccaggccgccttccag

SEQ ID NO: 17623 - DNA, 24 bp, Homo sapiens
aggaagcccccaggccgccttcca

SEQ ID NO: 17624 - DNA, 24 bp, Homo sapiens
aacacagggaacctcaggccaggc

SEQ ID NO: 17625 - DNA, 24 bp, Homo sapiens
caacacagggaacctcaggccagg

SEQ ID NO: 17626 - DNA, 24 bp, Homo sapiens
gcaacacagggaacctcaggccag

SEQ ID NO: 17627 - DNA, 25 bp, Homo sapiens
ccaaagaagccatcagagagcatca

SEQ ID NO: 17628 - DNA, 25 bp, Homo sapiens
tggagctgatgaggaagaattagga

SEQ ID NO: 17629 - DNA, 24 bp, Homo sapiens
gaagtgtagggagatgcttgctgc

SEQ ID NO: 17630 - DNA, 25 bp, Homo sapiens
gcagtccacaagaatcggaatgtca

SEQ ID NO: 17631 - DNA, 25 bp, Homo sapiens
ttcgcaagcagagtacagatgagga

SEQ ID NO: 17632 - DNA, 25 bp, Homo sapiens
ggcaaagtctctcatcaaatcctgg

SEQ ID NO: 17633 - DNA, 24 bp, Homo sapiens
gtttcttttagatgttttcacctc

SEQ ID NO: 17634 - DNA, 24 bp, Homo sapiens
tgtttcttttagatgttttcacct

SEQ ID NO: 17635 - DNA, 24 bp, Homo sapiens
ttgtttcttttagatgttttcacc

SEQ ID NO: 17636 - DNA, 24 bp, Homo sapiens
cttcctccaaaccagcaaccagca

SEQ ID NO: 17637 - DNA, 24 bp, Homo sapiens
tctcatattccacagtccagcagc

SEQ ID NO: 17638 - DNA, 24 bp, Homo sapiens
ctatccatcacactcctcagcaga

SEQ ID NO: 17639 - DNA, 24 bp, Homo sapiens
ataatggcaaatagaggaagcggg

SEQ ID NO: 17640 - DNA, 24 bp, Homo sapiens
ctcttcctgtacgcctcctgccaa

SEQ ID NO: 17641 - DNA, 24 bp, Homo sapiens
ttccagtcttcctccgatgtccac

SEQ ID NO: 17642 - DNA, 24 bp, Homo sapiens
cttcatgcaagatggccatcacag

SEQ ID NO: 17643 - DNA, 24 bp, Homo sapiens
tcttcatgcaagatggccatcaca

SEQ ID NO: 17644 - DNA, 24 bp, Homo sapiens
ttcttcatgcaagatggccatcac

SEQ ID NO: 17645 - DNA, 24 bp, Homo sapiens
aaggtgtcaggtgtggttggagac

SEQ ID NO: 17646 - DNA, 24 bp, Homo sapiens
atgtgaaaggtatgcctccgtggg

SEQ ID NO: 17647 - DNA, 24 bp, Homo sapiens
ggcttcatccacatccacacctca

SEQ ID NO: 17648 - DNA, 24 bp, Homo sapiens
tcatttttcagcacaaggccaatc

SEQ ID NO: 17649 - DNA, 24 bp, Homo sapiens
ctcatttttcagcacaaggccaat

SEQ ID NO: 17650 - DNA, 24 bp, Homo sapiens
tctcatttttcagcacaaggccaa

SEQ ID NO: 17651 - DNA, 24 bp, Homo sapiens
tgggccgcagggtgagaccatggg

SEQ ID NO: 17652 - DNA, 24 bp, Homo sapiens
ctgggccgcagggtgagaccatgg

SEQ ID NO: 17653 - DNA, 24 bp, Homo sapiens
cctgggccgcagggtgagaccatg

SEQ ID NO: 17654 - DNA, 24 bp, Homo sapiens
atccaccacaggaggaaaaagaaa

SEQ ID NO: 17655 - DNA, 24 bp, Homo sapiens
aatccaccacaggaggaaaaagaa

SEQ ID NO: 17656 - DNA, 24 bp, Homo sapiens
gaatccaccacaggaggaaaaaga

SEQ ID NO: 17657 - DNA, 24 bp, Homo sapiens
agcccccgctggagagaaaatgca

SEQ ID NO: 17658 - DNA, 24 bp, Homo sapiens
cagcccccgctggagagaaaatgc

SEQ ID NO: 17659 - DNA, 24 bp, Homo sapiens
gcagcccccgctggagagaaaatg

SEQ ID NO: 17660 - DNA, 24 bp, Homo sapiens
ccgttccttccgatgacagtgctc

SEQ ID NO: 17661 - DNA, 25 bp, Homo sapiens
aacaggaatctcagagacaggtggc

SEQ ID NO: 17662 - DNA, 25 bp, Homo sapiens
gactcaccctcataccatctgctgc

SEQ ID NO: 17663 - DNA, 24 bp, Homo sapiens
ctgccgggccaggcgcggtggctc

SEQ ID NO: 17664 - DNA, 24 bp, Homo sapiens
gctgccgggccaggcgcggtggct

SEQ ID NO: 17665 - DNA, 24 bp, Homo sapiens
ggctgccgggccaggcgcggtggc

SEQ ID NO: 17666 - DNA, 23 bp, Homo sapiens
gcggtcgagggaaaagcaccaag

SEQ ID NO: 17667 - DNA, 24 bp, Homo sapiens
ccgcccgaacctatctccagatga

SEQ ID NO: 17668 - DNA, 24 bp, Homo sapiens
accgcccgaacctatctccagatg

SEQ ID NO: 17669 - DNA, 24 bp, Homo sapiens
caccgcccgaacctatctccagat

SEQ ID NO: 17670 - DNA, 24 bp, Homo sapiens
aagaggaaaagggacaagcagccg

SEQ ID NO: 17671 - DNA, 23 bp, Homo sapiens
gcaacctccacagttcaagcgag

SEQ ID NO: 17672 - DNA, 23 bp, Homo sapiens
caggctggagttcaatggcacca

SEQ ID NO: 17673 - DNA, 23 bp, Homo sapiens
tgattctcctgtctcagcttccc

SEQ ID NO: 17674 - DNA, 24 bp, Homo sapiens
gcaggtttgactatccagaggaaa

SEQ ID NO: 17675 - DNA, 24 bp, Homo sapiens
ggcaggtttgactatccagaggaa

SEQ ID NO: 17676 - DNA, 24 bp, Homo sapiens
tggcaggtttgactatccagagga

SEQ ID NO: 17677 - DNA, 24 bp, Homo sapiens
ttgtctgaggattacggcgtgctg

SEQ ID NO: 17678 - DNA, 24 bp, Homo sapiens
ggtgtccttcgccagatcactgtt

SEQ ID NO: 17679 - DNA, 24 bp, Homo sapiens
gccttccagtacacagacgagcat

SEQ ID NO: 17680 - DNA, 24 bp, Homo sapiens
cccatgcccaggccgacctcaaca

SEQ ID NO: 17681 - DNA, 24 bp, Homo sapiens
ccccatgcccaggccgacctcaac

SEQ ID NO: 17682 - DNA, 24 bp, Homo sapiens
cccccatgcccaggccgacctcaa

SEQ ID NO: 17683 - DNA, 24 bp, Homo sapiens
gggttaggaagagtggagactgct

SEQ ID NO: 17684 - DNA, 24 bp, Homo sapiens
cgggttaggaagagtggagactgc

SEQ ID NO: 17685 - DNA, 24 bp, Homo sapiens
gcgggttaggaagagtggagactg

SEQ ID NO: 17686 - DNA, 24 bp, Homo sapiens
ctcaagtccaggagtttgatgaaa

SEQ ID NO: 17687 - DNA, 24 bp, Homo sapiens
gctcaagtccaggagtttgatgaa

SEQ ID NO: 17688 - DNA, 24 bp, Homo sapiens
ggctcaagtccaggagtttgatga

SEQ ID NO: 17689 - DNA, 24 bp, Homo sapiens
cccgctctccagtcagtcactgcc

SEQ ID NO: 17690 - DNA, 24 bp, Homo sapiens
ccccgctctccagtcagtcactgc

SEQ ID NO: 17691 - DNA, 24 bp, Homo sapiens
accccgctctccagtcagtcactg

SEQ ID NO: 17692 - DNA, 24 bp, Homo sapiens
gtcagtgagctgcctggaaccttg

SEQ ID NO: 17693 - DNA, 24 bp, Homo sapiens
gggaatgaagatgtgccactcggg

SEQ ID NO: 17694 - DNA, 24 bp, Homo sapiens
gcaaagcctgaagacactggtagc

SEQ ID NO: 17695 - DNA, 24 bp, Homo sapiens
acctcctcacgatggccaaaaagg

SEQ ID NO: 17696 - DNA, 24 bp, Homo sapiens
tacctcctcacgatggccaaaaag

SEQ ID NO: 17697 - DNA, 24 bp, Homo sapiens
ctacctcctcacgatggccaaaaa

SEQ ID NO: 17698 - DNA, 24 bp, Homo sapiens
gctacggaatcctccaaccaccat

SEQ ID NO: 17699 - DNA, 24 bp, Homo sapiens
ggaagataaacagccagcaccagg

SEQ ID NO: 17700 - DNA, 24 bp, Homo sapiens
ggctttgaaatctgagtccgctgc

SEQ ID NO: 17701 - DNA, 24 bp, Homo sapiens
cttcctggagagccacctggatga

SEQ ID NO: 17702 - DNA, 24 bp, Homo sapiens
ccaaggaccccacaactcagaagc

SEQ ID NO: 17703 - DNA, 24 bp, Homo sapiens
gcccatcctgttatccagaacttt

SEQ ID NO: 17704 - DNA, 24 bp, Homo sapiens
aactggtcaaggaagctgctgtca

SEQ ID NO: 17705 - DNA, 24 bp, Homo sapiens
gagagccacctggatgacgccgag

SEQ ID NO: 17706 - DNA, 24 bp, Homo sapiens
ggctttgaaatctgagtccgctgc

SEQ ID NO: 17707 - DNA, 24 bp, Homo sapiens
gaggccgactactacgccaaggag

SEQ ID NO: 17708 - DNA, 24 bp, Homo sapiens
gcgtgctaatggtggaaacccaca

SEQ ID NO: 17709 - DNA, 24 bp, Homo sapiens
gaggccgtgctcgccctgtacaac

SEQ ID NO: 17710 - DNA, 24 bp, Homo sapiens
ttgcactccagtgcggccatgctg

SEQ ID NO: 17711 - DNA, 24 bp, Homo sapiens
gttgcactccagtgcggccatgct

SEQ ID NO: 17712 - DNA, 24 bp, Homo sapiens
tgttgcactccagtgcggccatgc

SEQ ID NO: 17713 - DNA, 24 bp, Homo sapiens
atctccatctcctgacctcgtgat

SEQ ID NO: 17714 - DNA, 24 bp, Homo sapiens
cagccctggagcccacctgcttcc

SEQ ID NO: 17715 - DNA, 24 bp, Homo sapiens
acagccctggagcccacctgcttc

SEQ ID NO: 17716 - DNA, 24 bp, Homo sapiens
aacagccctggagcccacctgctt

SEQ ID NO: 17717 - DNA, 24 bp, Homo sapiens
actccgcagactactcctcagaga

SEQ ID NO: 17718 - DNA, 24 bp, Homo sapiens
agacaagacacgcctgctcaagaa

SEQ ID NO: 17719 - DNA, 24 bp, Homo sapiens
cccgattagtccagcctctattgc

SEQ ID NO: 17720 - DNA, 24 bp, Homo sapiens
tgcctcctctgacttcagcccagc

SEQ ID NO: 17721 - DNA, 24 bp, Homo sapiens
atgcctcctctgacttcagcccag

SEQ ID NO: 17722 - DNA, 24 bp, Homo sapiens
catgcctcctctgacttcagccca

SEQ ID NO: 17723 - DNA, 24 bp, Homo sapiens
aacgacttcaggctgctggcaacg

SEQ ID NO: 17724 - DNA, 24 bp, Homo sapiens
aaacgacttcaggctgctggcaac

SEQ ID NO: 17725 - DNA, 24 bp, Homo sapiens
gaaacgacttcaggctgctggcaa

SEQ ID NO: 17726 - DNA, 24 bp, Homo sapiens
ggcacccggccagaaggagtgtga

SEQ ID NO: 17727 - DNA, 24 bp, Homo sapiens
aggcacccggccagaaggagtgtg

SEQ ID NO: 17728 - DNA, 24 bp, Homo sapiens
caggcacccggccagaaggagtgt

SEQ ID NO: 17729 - DNA, 24 bp, Homo sapiens
ctagcccgttctctcaagacttac

SEQ ID NO: 17730 - DNA, 24 bp, Homo sapiens
tgagattgaggccaaggtccgcta

SEQ ID NO: 17731 - DNA, 24 bp, Homo sapiens
agcagattgcacagctcattgccg

SEQ ID NO: 17732 - DNA, 24 bp, Homo sapiens
tggctattactcagtacagacaac

SEQ ID NO: 17733 - DNA, 24 bp, Homo sapiens
ctctggagcctctggtcctgagaa

SEQ ID NO: 17734 - DNA, 24 bp, Homo sapiens
ggctggaaggagatgaggagtcta

SEQ ID NO: 17735 - DNA, 24 bp, Homo sapiens
ccaggagtggaacctcaccaacat

SEQ ID NO: 17736 - DNA, 24 bp, Homo sapiens
gagaacccagtccagcccatcaat

SEQ ID NO: 17737 - DNA, 24 bp, Homo sapiens
tggttgcctggacagtgtaatgga

SEQ ID NO: 17738 - DNA, 24 bp, Homo sapiens
aatgccaagaacggaaacctgcca

SEQ ID NO: 17739 - DNA, 24 bp, Homo sapiens
agatgccatttccacagcctcaaa

SEQ ID NO: 17740 - DNA, 24 bp, Homo sapiens
aatgccaagaacggaaacctgcca

SEQ ID NO: 17741 - DNA, 24 bp, Homo sapiens
tggttgcctggacagtgtaatgga

SEQ ID NO: 17742 - DNA, 24 bp, Homo sapiens
ccaggtggtactaatcaacgcagt

SEQ ID NO: 17743 - DNA, 24 bp, Homo sapiens
gttggagatgaccctgctgtgtgg

SEQ ID NO: 17744 - DNA, 24 bp, Homo sapiens
aactctgccaaggtgatggtgacc

SEQ ID NO: 17745 - DNA, 24 bp, Homo sapiens
gttggagatgaccctgctgtgtgg

SEQ ID NO: 17746 - DNA, 24 bp, Homo sapiens
gtgaaagatgtagccaaagccctg

SEQ ID NO: 17747 - DNA, 24 bp, Homo sapiens
ctcatcagtgcaacgaaggctgca

SEQ ID NO: 17748 - DNA, 24 bp, Homo sapiens
atggctacctggaactgctggacc

SEQ ID NO: 17749 - DNA, 24 bp, Homo sapiens
tgaagcagcagttgacaggacatt

SEQ ID NO: 17750 - DNA, 24 bp, Homo sapiens
gtgtggctggttccgtcactgagc

SEQ ID NO: 17751 - DNA, 24 bp, Homo sapiens
aagtccattgcagcagccaccagt

SEQ ID NO: 17752 - DNA, 24 bp, Homo sapiens
gctgcgtcggctgcccagagagaa

SEQ ID NO: 17753 - DNA, 24 bp, Homo sapiens
aactttgaggagcagatactagaa

SEQ ID NO: 17754 - DNA, 24 bp, Homo sapiens
catctcatcagccaagcaggtagc

SEQ ID NO: 17755 - DNA, 24 bp, Homo sapiens
tgaccaggactcggaggcaatgaa

SEQ ID NO: 17756 - DNA, 24 bp, Homo sapiens
gcagtgaagcgagcctcagataat

SEQ ID NO: 17757 - DNA, 24 bp, Homo sapiens
ctcatctcatcagccaagcaggta

SEQ ID NO: 17758 - DNA, 24 bp, Homo sapiens
caccaacaatctgtgtgaggcagc

SEQ ID NO: 17759 - DNA, 24 bp, Homo sapiens
gtcaaggctgaccaggactcggag

SEQ ID NO: 17760 - DNA, 24 bp, Homo sapiens
catctcatcagccaagcaggtagc

SEQ ID NO: 17761 - DNA, 24 bp, Homo sapiens
caccaacaatctgtgtgaggcagc

SEQ ID NO: 17762 - DNA, 24 bp, Homo sapiens
cactggtaaaggctgcgtcggctg

SEQ ID NO: 17763 - DNA, 24 bp, Homo sapiens
gagccgtgtttccttccatcgtcg

SEQ ID NO: 17764 - DNA, 24 bp, Homo sapiens
cagagcaagcgtggcatcctgacc

SEQ ID NO: 17765 - DNA, 24 bp, Homo sapiens
tgagcatggcatcgtcaccaactg

SEQ ID NO: 17766 - DNA, 24 bp, Homo sapiens
ccactggcattgtcatggactctg

SEQ ID NO: 17767 - DNA, 24 bp, Homo sapiens
accactggcattgtcatggactct

SEQ ID NO: 17768 - DNA, 24 bp, Homo sapiens
caccactggcattgtcatggactc

SEQ ID NO: 17769 - DNA, 24 bp, Homo sapiens
gaggctacagcttcaccaccacgg

SEQ ID NO: 17770 - DNA, 24 bp, Homo sapiens
actggcattgtcatggactctgga

SEQ ID NO: 17771 - DNA, 24 bp, Homo sapiens
ggcaccacaccttctacaacgagc

SEQ ID NO: 17772 - DNA, 24 bp, Homo sapiens
ggacgacatggagaagatctggca

SEQ ID NO: 17773 - DNA, 24 bp, Homo sapiens
gggacgacatggagaagatctggc

SEQ ID NO: 17774 - DNA, 24 bp, Homo sapiens
tgggacgacatggagaagatctgg

SEQ ID NO: 17775 - DNA, 24 bp, Homo sapiens
agcgattctcttgcctcagcctcc

SEQ ID NO: 17776 - DNA, 24 bp, Homo sapiens
agtgacacaatctcggctgactgc

SEQ ID NO: 17777 - DNA, 24 bp, Homo sapiens
tggtgaaggaagaagtggggtgga

SEQ ID NO: 17778 - DNA, 24 bp, Homo sapiens
ttggtgaaggaagaagtggggtgg

SEQ ID NO: 17779 - DNA, 24 bp, Homo sapiens
gttggtgaaggaagaagtggggtg

SEQ ID NO: 17780 - DNA, 24 bp, Homo sapiens
atctgtctatctatctggctggca

SEQ ID NO: 17781 - DNA, 24 bp, Homo sapiens
gcatgttggtgaaggaagaagtgg

SEQ ID NO: 17782 - DNA, 24 bp, Homo sapiens
gggtgggacgacagtgaaatctag

SEQ ID NO: 17783 - DNA, 24 bp, Homo sapiens
ggcccggagaggtgttggagagca

SEQ ID NO: 17784 - DNA, 24 bp, Homo sapiens
gggcccggagaggtgttggagagc

SEQ ID NO: 17785 - DNA, 24 bp, Homo sapiens
ggggcccggagaggtgttggagag

SEQ ID NO: 17786 - DNA, 24 bp, Homo sapiens
cacagcgtccaggttccagaacac

SEQ ID NO: 17787 - DNA, 24 bp, Homo sapiens
ttgaaggatactgccagaagtgtt

SEQ ID NO: 17788 - DNA, 24 bp, Homo sapiens
gggaatgcggcacccttggaagca

SEQ ID NO: 17789 - DNA, 24 bp, Homo sapiens
tgtgctcttcgtcaactctgtgga

SEQ ID NO: 17790 - DNA, 24 bp, Homo sapiens
gctgccaccatcgttcacttcaaa

SEQ ID NO: 17791 - DNA, 24 bp, Homo sapiens
cctctcaacactgtcaccttctgt

SEQ ID NO: 17792 - DNA, 24 bp, Homo sapiens
cattgacgcagttcatgtgggtgt

SEQ ID NO: 17793 - DNA, 24 bp, Homo sapiens
ccattgacgcagttcatgtgggtg

SEQ ID NO: 17794 - DNA, 24 bp, Homo sapiens
gccattgacgcagttcatgtgggt

SEQ ID NO: 17795 - DNA, 24 bp, Homo sapiens
gagatgcaaaagggcgagaggtca

SEQ ID NO: 17796 - DNA, 24 bp, Homo sapiens
agagatgcaaaagggcgagaggtc

SEQ ID NO: 17797 - DNA, 24 bp, Homo sapiens
gagagatgcaaaagggcgagaggt

SEQ ID NO: 17798 - DNA, 24 bp, Homo sapiens
aaagttttgggtctaaatgccagc

SEQ ID NO: 17799 - DNA, 24 bp, Homo sapiens
agactaaggaaaacatgactctgc

SEQ ID NO: 17800 - DNA, 24 bp, Homo sapiens
ttgccttattgaaaatccaacttt

SEQ ID NO: 17801 - DNA, 24 bp, Homo sapiens
tttccactcaggggcaaaattctt

SEQ ID NO: 17802 - DNA, 24 bp, Homo sapiens
accttacgctatggaaagattatg

SEQ ID NO: 17803 - DNA, 24 bp, Homo sapiens
ccgatcaggatcaagatggttctc

SEQ ID NO: 17804 - DNA, 24 bp, Homo sapiens
acaacgttctgtcccccttgccgt

SEQ ID NO: 17805 - DNA, 24 bp, Homo sapiens
aacaacgttctgtcccccttgccg

SEQ ID NO: 17806 - DNA, 24 bp, Homo sapiens
aaacaacgttctgtcccccttgcc

SEQ ID NO: 17807 - DNA, 24 bp, Homo sapiens
tgacttgcacgtactcccctgccc

SEQ ID NO: 17808 - DNA, 24 bp, Homo sapiens
gtgacttgcacgtactcccctgcc

SEQ ID NO: 17809 - DNA, 24 bp, Homo sapiens
tgtgacttgcacgtactcccctgc

SEQ ID NO: 17810 - DNA, 24 bp, Homo sapiens
tgatgctgtccccggacgatattg

SEQ ID NO: 17811 - DNA, 24 bp, Homo sapiens
ggttcactgaagacccaggtccag

SEQ ID NO: 17812 - DNA, 24 bp, Homo sapiens
tcccccttgccgtcccaagcaatg

SEQ ID NO: 17813 - DNA, 24 bp, Homo sapiens
catggaggagccgcagtcagatcc

SEQ ID NO: 17814 - DNA, 24 bp, Homo sapiens
gacggtgacacgcttccctggatt

SEQ ID NO: 17815 - DNA, 24 bp, Homo sapiens
gacactttgcgttcgggctgggag

SEQ ID NO: 17816 - DNA, 25 bp, Homo sapiens
tgacctgaatgagatgtagaacgcc

SEQ ID NO: 17817 - DNA, 23 bp, Homo sapiens
ctgctgctgctcctccctctgac

SEQ ID NO: 17818 - DNA, 24 bp, Homo sapiens
ggctgctttctcctttcaccaccc

SEQ ID NO: 17819 - DNA, 24 bp, Homo sapiens
ttgccattcagagccaatttacaa

SEQ ID NO: 17820 - DNA, 24 bp, Homo sapiens
attgccattcagagccaatttaca

SEQ ID NO: 17821 - DNA, 24 bp, Homo sapiens
tattgccattcagagccaatttac

SEQ ID NO: 17822 - DNA, 24 bp, Homo sapiens
agcagccccagtgactgtatttac

SEQ ID NO: 17823 - DNA, 24 bp, Homo sapiens
tagcagccccagtgactgtattta

SEQ ID NO: 17824 - DNA, 24 bp, Homo sapiens
gtagcagccccagtgactgtattt

SEQ ID NO: 17825 - DNA, 24 bp, Homo sapiens
agaggctatagaggctaaggctgc

SEQ ID NO: 17826 - DNA, 24 bp, Homo sapiens
ttccactcctgctccagtacctgt

SEQ ID NO: 17827 - DNA, 24 bp, Homo sapiens
aacaggagttgccattccattaca

SEQ ID NO: 17828 - DNA, 24 bp, Homo sapiens
agcaaagagcaatgaactaacccg

SEQ ID NO: 17829 - DNA, 24 bp, Homo sapiens
ggtgaagccaacaaagcaatacaa

SEQ ID NO: 17830 - DNA, 24 bp, Homo sapiens
caaatgaccttctttctgccacaa

SEQ ID NO: 17831 - DNA, 24 bp, Homo sapiens
caaatgaccttctttctgccacaa

SEQ ID NO: 17832 - DNA, 24 bp, Homo sapiens
gcttgccgccatgtctcctactgc

SEQ ID NO: 17833 - DNA, 24 bp, Homo sapiens
aacctgggatgaaactaactgagc

SEQ ID NO: 17834 - DNA, 24 bp, Homo sapiens
gcttgccgccatgtctcctactgc

SEQ ID NO: 17835 - DNA, 24 bp, Homo sapiens
aacctgggatgaaactaactgagc

SEQ ID NO: 17836 - DNA, 24 bp, Homo sapiens
aaagaagtggaagccaaagcacca

SEQ ID NO: 17837 - DNA, 24 bp, Homo sapiens
aaagaagtggaagccaaagcacca

SEQ ID NO: 17838 - DNA, 24 bp, Homo sapiens
cgccagcgtgaggaatatgaacgt

SEQ ID NO: 17839 - DNA, 24 bp, Homo sapiens
actcaggatcagttgcttttggag

SEQ ID NO: 17840 - DNA, 24 bp, Homo sapiens
agccaacaagcaatcatctgtact

SEQ ID NO: 17841 - DNA, 24 bp, Homo sapiens
aggagattcagcgattgcaggagg

SEQ ID NO: 17842 - DNA, 24 bp, Homo sapiens
aaagaagtggaagccaaagcacca

SEQ ID NO: 17843 - DNA, 24 bp, Homo sapiens
ttccactcctgctccagtacctgt

SEQ ID NO: 17844 - DNA, 24 bp, Homo sapiens
aacaggagttgccattccattaca

SEQ ID NO: 17845 - DNA, 24 bp, Homo sapiens
tgattccatagttcgtcagcgtga

SEQ ID NO: 17846 - DNA, 24 bp, Homo sapiens
tagagaacaacagccatcatcagc

SEQ ID NO: 17847 - DNA, 24 bp, Homo sapiens
gagacgcccaccacatccacttcc

SEQ ID NO: 17848 - DNA, 24 bp, Homo sapiens
gaccattcatgccccacctcagga

SEQ ID NO: 17849 - DNA, 24 bp, Homo sapiens
ctcacccacaggtaacacgtacac

SEQ ID NO: 17850 - DNA, 24 bp, Homo sapiens
tctcacccacaggtaacacgtaca

SEQ ID NO: 17851 - DNA, 24 bp, Homo sapiens
ttctcacccacaggtaacacgtac

SEQ ID NO: 17852 - DNA, 24 bp, Homo sapiens
caaagcctccggccgtcactatgg

SEQ ID NO: 17853 - DNA, 24 bp, Homo sapiens
acaaagcctccggccgtcactatg

SEQ ID NO: 17854 - DNA, 24 bp, Homo sapiens
gacaaagcctccggccgtcactat

SEQ ID NO: 17855 - DNA, 24 bp, Homo sapiens
cgccaagcaactcatattcaccac

SEQ ID NO: 17856 - DNA, 24 bp, Homo sapiens
aacagcagttcatcctgaccagcc

SEQ ID NO: 17857 - DNA, 24 bp, Homo sapiens
gatagtcaccgcagtggacgcctc

SEQ ID NO: 17858 - DNA, 24 bp, Homo sapiens
gaaaagtttgccttccaagccgaa

SEQ ID NO: 17859 - DNA, 24 bp, Homo sapiens
actgatttcaaatgcttctgatgc

SEQ ID NO: 17860 - DNA, 24 bp, Homo sapiens
gataaggctaatatcactgactga

SEQ ID NO: 17861 - DNA, 24 bp, Homo sapiens
ttgctgtggttttgtttgaaacag

SEQ ID NO: 17862 - DNA, 24 bp, Homo sapiens
cttgctgtggttttgtttgaaaca

SEQ ID NO: 17863 - DNA, 24 bp, Homo sapiens
tcttgctgtggttttgtttgaaac

SEQ ID NO: 17864 - DNA, 24 bp, Homo sapiens
aatgctctttctggaaatgaggaa

SEQ ID NO: 17865 - DNA, 24 bp, Homo sapiens
ttcaaatgcttctgatgctttaga

SEQ ID NO: 17866 - DNA, 24 bp, Homo sapiens
gtgtaggaatgaccagagaagagt

SEQ ID NO: 17867 - DNA, 24 bp, Homo sapiens
atgactgaagcacaggaagatggc

SEQ ID NO: 17868 - DNA, 24 bp, Homo sapiens
tctattccgccttccttgtagcag

SEQ ID NO: 17869 - DNA, 24 bp, Homo sapiens
agcatctgattaccttgaattgga

SEQ ID NO: 17870 - DNA, 24 bp, Homo sapiens
agactgaaactgttgaggagccca

SEQ ID NO: 17871 - DNA, 24 bp, Homo sapiens
agcagccaaagaagagaaagaaga

SEQ ID NO: 17872 - DNA, 24 bp, Homo sapiens
attgctgacccaagaggaaacact

SEQ ID NO: 17873 - DNA, 24 bp, Homo sapiens
aacacaacaacgatacccagcaca

SEQ ID NO: 17874 - DNA, 24 bp, Homo sapiens
tctattccgccttccttgtagcag

SEQ ID NO: 17875 - DNA, 24 bp, Homo sapiens
agaggttccagaatgttgccaagg

SEQ ID NO: 17876 - DNA, 24 bp, Homo sapiens
aggagagtcgtgaagcagttgaga

SEQ ID NO: 17877 - DNA, 24 bp, Homo sapiens
gcctgacagaatctccgtgtgctt

SEQ ID NO: 17878 - DNA, 24 bp, Homo sapiens
aggagagtcgtgaagcagttgaga

SEQ ID NO: 17879 - DNA, 24 bp, Homo sapiens
agaggttccagaatgttgccaagg

SEQ ID NO: 17880 - DNA, 24 bp, Homo sapiens
ttgagcctctgctgaattggatga

SEQ ID NO: 17881 - DNA, 24 bp, Homo sapiens
agtacggatggtctggcaacatgg

SEQ ID NO: 17882 - DNA, 24 bp, Homo sapiens
gcctgacagaatctccgtgtgctt

SEQ ID NO: 17883 - DNA, 24 bp, Homo sapiens
aggagagtcgtgaagcagttgaga

SEQ ID NO: 17884 - DNA, 24 bp, Homo sapiens
gacatctgctggtgcatttaaaaa

SEQ ID NO: 17885 - DNA, 24 bp, Homo sapiens
ggacatctgctggtgcatttaaaa

SEQ ID NO: 17886 - DNA, 24 bp, Homo sapiens
gggacatctgctggtgcatttaaa

SEQ ID NO: 17887 - DNA, 25 bp, Homo sapiens
tgtcggaatgaaagcagaggttgtg

SEQ ID NO: 17888 - DNA, 23 bp, Homo sapiens
aatgctgggacatctgctggtgc

SEQ ID NO: 17889 - DNA, 23 bp, Homo sapiens
gcaagagtcaggttccgatgatc

SEQ ID NO: 17890 - DNA, 25 bp, Homo sapiens
tcctgaagctgagcaagactgtcct

SEQ ID NO: 17891 - DNA, 25 bp, Homo sapiens
tggaaggtgacagattacaagatga

SEQ ID NO: 17892 - DNA, 25 bp, Homo sapiens
cttcagccagtccttctacaccagc

SEQ ID NO: 17893 - DNA, 23 bp, Homo sapiens
gtgaccctgatgcttctggacca

SEQ ID NO: 17894 - DNA, 24 bp, Homo sapiens
cctcaattctgaccgtggccctat

SEQ ID NO: 17895 - DNA, 24 bp, Homo sapiens
acctcaattctgaccgtggcccta

SEQ ID NO: 17896 - DNA, 24 bp, Homo sapiens
aacctcaattctgaccgtggccct

SEQ ID NO: 17897 - DNA, 24 bp, Homo sapiens
cacatgacaagcacctcttggaca

SEQ ID NO: 17898 - DNA, 24 bp, Homo sapiens
ccacatgacaagcacctcttggac

SEQ ID NO: 17899 - DNA, 24 bp, Homo sapiens
gccacatgacaagcacctcttgga

SEQ ID NO: 17900 - DNA, 25 bp, Homo sapiens
tgaagtaccagttgtcgctagaaca

SEQ ID NO: 17901 - DNA, 25 bp, Homo sapiens
gaaccttcagaacctgtagcacacg

SEQ ID NO: 17902 - DNA, 25 bp, Homo sapiens
agagaacctcaattctgaccgtggc

SEQ ID NO: 17903 - DNA, 25 bp, Homo sapiens
gaaccttcagaacctgtagcacacg

SEQ ID NO: 17904 - DNA, 25 bp, Homo sapiens
agagaacctcaattctgaccgtggc

SEQ ID NO: 17905 - DNA, 24 bp, Homo sapiens
gcaagagccacatgacaagcacct

SEQ ID NO: 17906 - DNA, 24 bp, Homo sapiens
ggagcttcttgccatgctggactc

SEQ ID NO: 17907 - DNA, 25 bp, Homo sapiens
gaaccttcagaacctgtagcacacg

SEQ ID NO: 17908 - DNA, 25 bp, Homo sapiens
aagtaccagttgtcgctagaacagt

SEQ ID NO: 17909 - DNA, 23 bp, Homo sapiens
gcagccatcttggaagcataagc

SEQ ID NO: 17910 - DNA, 25 bp, Homo sapiens
atcctctcgttactgggtcatgtca

SEQ ID NO: 17911 - DNA, 23 bp, Homo sapiens
cgaatatgtgggcaaagccgcca

SEQ ID NO: 17912 - DNA, 24 bp, Homo sapiens
aggtgatctggcctctgaagaaga

SEQ ID NO: 17913 - DNA, 25 bp, Homo sapiens
ctgtcactctaagtgatcttccagg

SEQ ID NO: 17914 - DNA, 25 bp, Homo sapiens
aggagcagcgtgacactatggtaac

SEQ ID NO: 17915 - DNA, 25 bp, Homo sapiens
aaccagagccaggaattacagacga

SEQ ID NO: 17916 - DNA, 24 bp, Homo sapiens
gctgcggatagaactgaagaaggc

SEQ ID NO: 17917 - DNA, 24 bp, Homo sapiens
gctgcggatagaactgaagaaggc

SEQ ID NO: 17918 - DNA, 23 bp, Homo sapiens
agtgagtcggtccagcagcagat

SEQ ID NO: 17919 - DNA, 25 bp, Homo sapiens
gcagaacaagcactcagataccaca

SEQ ID NO: 17920 - DNA, 25 bp, Homo sapiens
agcagatggagttcttgaacaggca

SEQ ID NO: 17921 - DNA, 25 bp, Homo sapiens
gcagaacaagcactcagataccaca

SEQ ID NO: 17922 - DNA, 23 bp, Homo sapiens
ttggaactggaatctcacctggc

SEQ ID NO: 17923 - DNA, 24 bp, Homo sapiens
tgtcctcccagactccgccgtggt

SEQ ID NO: 17924 - DNA, 24 bp, Homo sapiens
gtgtcctcccagactccgccgtgg

SEQ ID NO: 17925 - DNA, 24 bp, Homo sapiens
tgtgtcctcccagactccgccgtg

SEQ ID NO: 17926 - DNA, 23 bp, Homo sapiens
ggttcacgccattctcctgcctc

SEQ ID NO: 17927 - DNA, 23 bp, Homo sapiens
atctcctgacctcgtgatctgcc

SEQ ID NO: 17928 - DNA, 23 bp, Homo sapiens
agctggtactacaggtgcctgcc

SEQ ID NO: 17929 - DNA, 24 bp, Homo sapiens
gcatgtgccaggtgagcctatttc

SEQ ID NO: 17930 - DNA, 24 bp, Homo sapiens
agcatgtgccaggtgagcctattt

SEQ ID NO: 17931 - DNA, 24 bp, Homo sapiens
tagcatgtgccaggtgagcctatt

SEQ ID NO: 17932 - DNA, 24 bp, Homo sapiens
tccgctaacaggtcaaaatgcaga

SEQ ID NO: 17933 - DNA, 24 bp, Homo sapiens
atccgctaacaggtcaaaatgcag

SEQ ID NO: 17934 - DNA, 24 bp, Homo sapiens
tatccgctaacaggtcaaaatgca

SEQ ID NO: 17935 - DNA, 24 bp, Homo sapiens
ggtcctgcgtctgagaggtggtat

SEQ ID NO: 17936 - DNA, 24 bp, Homo sapiens
agaccatcactctggaggtggagc

SEQ ID NO: 17937 - DNA, 24 bp, Homo sapiens
gccgcactctttctgactacaaca

SEQ ID NO: 17938 - DNA, 24 bp, Homo sapiens
ggcaagaccatcaccctggaagtg

SEQ ID NO: 17939 - DNA, 24 bp, Homo sapiens
ggtcctgcgtctgagaggtggtat

SEQ ID NO: 17940 - DNA, 24 bp, Homo sapiens
ccaagatccaggataaggaaggca

SEQ ID NO: 17941 - DNA, 24 bp, Homo sapiens
catcaccctggaagtggagcccag

SEQ ID NO: 17942 - DNA, 24 bp, Homo sapiens
ccatcaccctggaagtggagccca

SEQ ID NO: 17943 - DNA, 24 bp, Homo sapiens
accatcaccctggaagtggagccc

SEQ ID NO: 17944 - DNA, 24 bp, Homo sapiens
catcactctggaggtggagcccag

SEQ ID NO: 17945 - DNA, 24 bp, Homo sapiens
ccatcactctggaggtggagccca

SEQ ID NO: 17946 - DNA, 24 bp, Homo sapiens
accatcactctggaggtggagccc

SEQ ID NO: 17947 - DNA, 24 bp, Homo sapiens
ggtcctgcgtctgagaggtggtat

SEQ ID NO: 17948 - DNA, 24 bp, Homo sapiens
ccgaccagcagaggctcatctttg

SEQ ID NO: 17949 - DNA, 24 bp, Homo sapiens
ctgaccggcaagaccatcactctg

SEQ ID NO: 17950 - DNA, 24 bp, Homo sapiens
ggccaagatccaagataaagaagg

SEQ ID NO: 17951 - DNA, 24 bp, Homo sapiens
agaccatcacccttgaggtggagc

SEQ ID NO: 17952 - DNA, 24 bp, Homo sapiens
tgcagatcttcgtgaaaaccctta

SEQ ID NO: 17953 - DNA, 24 bp, Homo sapiens
gaaggcatccctcctgaccagcag

SEQ ID NO: 17954 - DNA, 24 bp, Homo sapiens
acaccatcgagaatgtcaaggcaa

SEQ ID NO: 17955 - DNA, 24 bp, Homo sapiens
cgcagttcttgtttgtggatcgct

SEQ ID NO: 17956 - DNA, 24 bp, Homo sapiens
tcaccctcgaggtggagcccagtg

SEQ ID NO: 17957 - DNA, 24 bp, Homo sapiens
atcaccctcgaggtggagcccagt

SEQ ID NO: 17958 - DNA, 24 bp, Homo sapiens
catcaccctcgaggtggagcccag

SEQ ID NO: 17959 - DNA, 24 bp, Homo sapiens
ccatcaccctcgaggtggagccca

SEQ ID NO: 17960 - DNA, 24 bp, Homo sapiens
accatcaccctcgaggtggagccc

SEQ ID NO: 17961 - DNA, 24 bp, Homo sapiens
gaccatcaccctcgaggtggagcc

SEQ ID NO: 17962 - DNA, 24 bp, Homo sapiens
acactcactggcaagaccatcacc

SEQ ID NO: 17963 - DNA, 24 bp, Homo sapiens
cctggtactccgtctcagaggtgg

SEQ ID NO: 17964 - DNA, 24 bp, Homo sapiens
cctggtgctccgtctcagaggtgg

SEQ ID NO: 17965 - DNA, 24 bp, Homo sapiens
tcgtgaagacactcactggcaaga

SEQ ID NO: 17966 - DNA, 24 bp, Homo sapiens
ttcgtgaagacactcactggcaag

SEQ ID NO: 17967 - DNA, 24 bp, Homo sapiens
cttcgtgaagacactcactggcaa

SEQ ID NO: 17968 - DNA, 24 bp, Homo sapiens
gaccatcacccttgaggtcgagcc

SEQ ID NO: 17969 - DNA, 24 bp, Homo sapiens
agaccatcacccttgaggtcgagc

SEQ ID NO: 17970 - DNA, 24 bp, Homo sapiens
aagaccatcacccttgaggtcgag

SEQ ID NO: 17971 - DNA, 24 bp, Homo sapiens
gcacctggtactccgtctcagagg

SEQ ID NO: 17972 - DNA, 24 bp, Homo sapiens
tgcacctggtactccgtctcagag

SEQ ID NO: 17973 - DNA, 24 bp, Homo sapiens
ttgcacctggtactccgtctcaga

SEQ ID NO: 17974 - DNA, 24 bp, Homo sapiens
ccttgcacctggtactccgtctca

SEQ ID NO: 17975 - DNA, 24 bp, Homo sapiens
atcaccctcgaggtggagcccagt

SEQ ID NO: 17976 - DNA, 24 bp, Homo sapiens
catcaccctcgaggtggagcccag

SEQ ID NO: 17977 - DNA, 24 bp, Homo sapiens
ccatcaccctcgaggtggagccca

SEQ ID NO: 17978 - DNA, 24 bp, Homo sapiens
aagtcatgaaggtcagcacgggtg

SEQ ID NO: 17979 - DNA, 24 bp, Homo sapiens
gaagtcatgaaggtcagcacgggt

SEQ ID NO: 17980 - DNA, 24 bp, Homo sapiens
ggaagtcatgaaggtcagcacggg

SEQ ID NO: 17981 - DNA, 24 bp, Homo sapiens
ctcctgaccagctcacaagctcag

SEQ ID NO: 17982 - DNA, 24 bp, Homo sapiens
cctcctgaccagctcacaagctca

SEQ ID NO: 17983 - DNA, 24 bp, Homo sapiens
ccctcctgaccagctcacaagctc

SEQ ID NO: 17984 - DNA, 24 bp, Homo sapiens
ttggatcagccgatgacagagatt

SEQ ID NO: 17985 - DNA, 24 bp, Homo sapiens
gttggatcagccgatgacagagat

SEQ ID NO: 17986 - DNA, 24 bp, Homo sapiens
ggttggatcagccgatgacagaga

SEQ ID NO: 17987 - DNA, 24 bp, Homo sapiens
tgcccagtccgtgttgtccgaagt

SEQ ID NO: 17988 - DNA, 24 bp, Homo sapiens
ctgcccagtccgtgttgtccgaag

SEQ ID NO: 17989 - DNA, 24 bp, Homo sapiens
cctgcccagtccgtgttgtccgaa

SEQ ID NO: 17990 - DNA, 24 bp, Homo sapiens
agattgtgagccgtgtgtcgaagc

SEQ ID NO: 17991 - DNA, 23 bp, Homo sapiens
gctggtgcttgagctgtgctgta

SEQ ID NO: 17992 - DNA, 23 bp, Homo sapiens
gagcggcgaggatgtcgaggttc

SEQ ID NO: 17993 - DNA, 25 bp, Homo sapiens
tagagatcaccatgctgtcccaggg

SEQ ID NO: 17994 - DNA, 25 bp, Homo sapiens
aatcatcgttacagacatggacacc

SEQ ID NO: 17995 - DNA, 23 bp, Homo sapiens
gtgacaagccaccagaaccgtgt

SEQ ID NO: 17996 - DNA, 23 bp, Homo sapiens
atggaccgccgctgtgtctacta

SEQ ID NO: 17997 - DNA, 23 bp, Homo sapiens
gtgacaagccaccagaaccgtgt

SEQ ID NO: 17998 - DNA, 23 bp, Homo sapiens
atggaccgccgctgtgtctacta

SEQ ID NO: 17999 - DNA, 25 bp, Homo sapiens
acagagtcgtacagttccagccagg

SEQ ID NO: 18000 - DNA, 23 bp, Homo sapiens
gtgacaagccaccagaaccgtgt

SEQ ID NO: 18001 - DNA, 25 bp, Homo sapiens
agttaaagtctgacacggctgctgc

SEQ ID NO: 18002 - DNA, 25 bp, Homo sapiens
aatcatcgttacagacatggacacc

SEQ ID NO: 18003 - DNA, 23 bp, Homo sapiens
gctgctgccaacctgtttgccca

SEQ ID NO: 18004 - DNA, 23 bp, Homo sapiens
ccaagtctggcgtcaagatccat

SEQ ID NO: 18005 - DNA, 23 bp, Homo sapiens
ctctcaggaccgagctgctgtgg

SEQ ID NO: 18006 - DNA, 23 bp, Homo sapiens
ccagccattgccacgaccacagc

SEQ ID NO: 18007 - DNA, 25 bp, Homo sapiens
gcagcctaatggtgaggagatgacc

SEQ ID NO: 18008 - DNA, 25 bp, Homo sapiens
ggcgtgtccatgctctattccttct

SEQ ID NO: 18009 - DNA, 24 bp, Homo sapiens
gatttcaagcggtaagggccttca

SEQ ID NO: 18010 - DNA, 24 bp, Homo sapiens
ggatttcaagcggtaagggccttc

SEQ ID NO: 18011 - DNA, 24 bp, Homo sapiens
gggatttcaagcggtaagggcctt

SEQ ID NO: 18012 - DNA, 24 bp, Homo sapiens
ttttgaagatggtaagtcatactc

SEQ ID NO: 18013 - DNA, 24 bp, Homo sapiens
cttttgaagatggtaagtcatact

SEQ ID NO: 18014 - DNA, 24 bp, Homo sapiens
ccttttgaagatggtaagtcatac

SEQ ID NO: 18015 - DNA, 23 bp, Homo sapiens
caccacctccgctcttcccgtca

SEQ ID NO: 18016 - DNA, 23 bp, Homo sapiens
gcacggtacagaggctgttggtg

SEQ ID NO: 18017 - DNA, 25 bp, Homo sapiens
gctgtcttaagggacctggattcat

SEQ ID NO: 18018 - DNA, 24 bp, Homo sapiens
agtgattctcctgcctcaacctcc

SEQ ID NO: 18019 - DNA, 24 bp, Homo sapiens
actcctgaccttagttgatccgcc

SEQ ID NO: 18020 - DNA, 24 bp, Homo sapiens
aattgtgcgatcttggctcactgc

SEQ ID NO: 18021 - DNA, 24 bp, Homo sapiens
gggctctgagcatgccagcattgg

SEQ ID NO: 18022 - DNA, 24 bp, Homo sapiens
agggctctgagcatgccagcattg

SEQ ID NO: 18023 - DNA, 24 bp, Homo sapiens
aagggctctgagcatgccagcatt

SEQ ID NO: 18024 - DNA, 24 bp, Homo sapiens
cctcatgacagatgacctcccttg

SEQ ID NO: 18025 - DNA, 24 bp, Homo sapiens
acctcatgacagatgacctccctt

SEQ ID NO: 18026 - DNA, 24 bp, Homo sapiens
aacctcatgacagatgacctccct

SEQ ID NO: 18027 - DNA, 24 bp, Homo sapiens
cccttgccacttcacttctgcctt

SEQ ID NO: 18028 - DNA, 24 bp, Homo sapiens
tcgcctcccctgtagacgtggtca

SEQ ID NO: 18029 - DNA, 24 bp, Homo sapiens
gatacatgaactctgccctgggcc

SEQ ID NO: 18030 - DNA, 24 bp, Homo sapiens
gtagcgctggccactgtgccctta

SEQ ID NO: 18031 - DNA, 24 bp, Homo sapiens
tcaaacagttctacaccaagggct

SEQ ID NO: 18032 - DNA, 24 bp, Homo sapiens
cctcctagcaggcagcaccacagg

SEQ ID NO: 18033 - DNA, 24 bp, Homo sapiens
caccgtcaatgcctacaagaccat

SEQ ID NO: 18034 - DNA, 24 bp, Homo sapiens
caccgtcaatgcctacaagaccat

SEQ ID NO: 18035 - DNA, 24 bp, Homo sapiens
tcgtaatgccattgtcaactgtgc

SEQ ID NO: 18036 - DNA, 24 bp, Homo sapiens
gatgccctcctgaaagccaacctc

SEQ ID NO: 18037 - DNA, 24 bp, Homo sapiens
tcgtaatgccattgtcaactgtgc

SEQ ID NO: 18038 - DNA, 24 bp, Homo sapiens
gatgccctcctgaaagccaacctc

SEQ ID NO: 18039 - DNA, 24 bp, Homo sapiens
ctcccttgccacttcacttctgcc

SEQ ID NO: 18040 - DNA, 24 bp, Homo sapiens
caccgtcaatgcctacaagaccat

SEQ ID NO: 18041 - DNA, 24 bp, Homo sapiens
ctcctagcaggcagcaccacaggt

SEQ ID NO: 18042 - DNA, 24 bp, Homo sapiens
tcaaacagttctacaccaagggct

SEQ ID NO: 18043 - DNA, 24 bp, Homo sapiens
ctcctttctccgcttgggttcctg

SEQ ID NO: 18044 - DNA, 24 bp, Homo sapiens
tgatgttcgtcacctatgagcagc

SEQ ID NO: 18045 - DNA, 24 bp, Homo sapiens
gcctctcctgctgctgacctgatc

SEQ ID NO: 18046 - DNA, 24 bp, Homo sapiens
ccactgtgcccttaccatgctcca

SEQ ID NO: 18047 - DNA, 24 bp, Homo sapiens
aagacgagatacatgaactctgcc

SEQ ID NO: 18048 - DNA, 24 bp, Homo sapiens
cactgtcatcgcctcccctgtaga

SEQ ID NO: 18049 - DNA, 24 bp, Homo sapiens
tgatgttcgtcacctatgagcagc

SEQ ID NO: 18050 - DNA, 24 bp, Homo sapiens
gcctctcctgctgctgacctgatc

SEQ ID NO: 18051 - DNA, 24 bp, Homo sapiens
ccctccttcccttctctccttccc

SEQ ID NO: 18052 - DNA, 24 bp, Homo sapiens
ggaagaggaagatcttagcaaagc

SEQ ID NO: 18053 - DNA, 24 bp, Homo sapiens
aggaagaggaagatcttagcaaag

SEQ ID NO: 18054 - DNA, 24 bp, Homo sapiens
aaggaagaggaagatcttagcaaa

SEQ ID NO: 18055 - DNA, 23 bp, Homo sapiens
agagagacctgccctgtagcgtg

SEQ ID NO: 18056 - DNA, 24 bp, Homo sapiens
ctcagtcgcaccaagtttccgtct

SEQ ID NO: 18057 - DNA, 25 bp, Homo sapiens
aggaggagaaagaatacatcggttg

SEQ ID NO: 18058 - DNA, 24 bp, Homo sapiens
taagcaggccgtttcagcatcagg

SEQ ID NO: 18059 - DNA, 24 bp, Homo sapiens
gtaagcaggccgtttcagcatcag

SEQ ID NO: 18060 - DNA, 24 bp, Homo sapiens
ggtaagcaggccgtttcagcatca

SEQ ID NO: 18061 - DNA, 24 bp, Homo sapiens
aatatgaagaggtctttgctgttc

SEQ ID NO: 18062 - DNA, 24 bp, Homo sapiens
aaatatgaagaggtctttgctgtt

SEQ ID NO: 18063 - DNA, 24 bp, Homo sapiens
caaatatgaagaggtctttgctgt

SEQ ID NO: 18064 - DNA, 24 bp, Homo sapiens
agcaatcctcctgcctcagcctgc

SEQ ID NO: 18065 - DNA, 24 bp, Homo sapiens
gtccaggctgatcttggactcctg

SEQ ID NO: 18066 - DNA, 24 bp, Homo sapiens
gctgcaggaaggtgacataccgcg

SEQ ID NO: 18067 - DNA, 24 bp, Homo sapiens
agctgcaggaaggtgacataccgc

SEQ ID NO: 18068 - DNA, 24 bp, Homo sapiens
gagctgcaggaaggtgacataccg

SEQ ID NO: 18069 - DNA, 24 bp, Homo sapiens
cttcatttcaggctcctgtggctg

SEQ ID NO: 18070 - DNA, 24 bp, Homo sapiens
gcttcatttcaggctcctgtggct

SEQ ID NO: 18071 - DNA, 24 bp, Homo sapiens
agcttcatttcaggctcctgtggc

SEQ ID NO: 18072 - DNA, 24 bp, Homo sapiens
gcctcacaggaacatcactgccaa

SEQ ID NO: 18073 - DNA, 24 bp, Homo sapiens
gggaactgacattgtggatggaaa

SEQ ID NO: 18074 - DNA, 24 bp, Homo sapiens
gcactggcaggtgaaagatgtcat

SEQ ID NO: 18075 - DNA, 24 bp, Homo sapiens
gggaactgacattgtggatggaaa

SEQ ID NO: 18076 - DNA, 24 bp, Homo sapiens
gcactggcaggtgaaagatgtcat

SEQ ID NO: 18077 - DNA, 24 bp, Homo sapiens
gcagcagacgaacagtgagaagat

SEQ ID NO: 18078 - DNA, 24 bp, Homo sapiens
aactcccagcactgtcactgaggt

SEQ ID NO: 18079 - DNA, 24 bp, Homo sapiens
attgcgttggaggaagtgctgacc

SEQ ID NO: 18080 - DNA, 24 bp, Homo sapiens
ggcaaccaactgataacacaagga

SEQ ID NO: 18081 - DNA, 24 bp, Homo sapiens
ggaagtgctgacctggttgctttc

SEQ ID NO: 18082 - DNA, 24 bp, Homo sapiens
aactcccagcactgtcactgaggt

SEQ ID NO: 18083 - DNA, 24 bp, Homo sapiens
ggacactttccaggagcaggatga

SEQ ID NO: 18084 - DNA, 24 bp, Homo sapiens
agatgtcccaggtgagccctccgc

SEQ ID NO: 18085 - DNA, 24 bp, Homo sapiens
cagatgtcccaggtgagccctccg

SEQ ID NO: 18086 - DNA, 24 bp, Homo sapiens
ccagatgtcccaggtgagccctcc

SEQ ID NO: 18087 - DNA, 24 bp, Homo sapiens
aagcctgtgctgaccttccagacg

SEQ ID NO: 18088 - DNA, 24 bp, Homo sapiens
ccgtggtgggagggtcgtctggta

SEQ ID NO: 18089 - DNA, 24 bp, Homo sapiens
gaagccctgccctgtggatggaag

SEQ ID NO: 18090 - DNA, 24 bp, Homo sapiens
cagttgccaaggcaggtgcaagat

SEQ ID NO: 18091 - DNA, 24 bp, Homo sapiens
ccagttgccaaggcaggtgcaaga

SEQ ID NO: 18092 - DNA, 24 bp, Homo sapiens
cccagttgccaaggcaggtgcaag

SEQ ID NO: 18093 - DNA, 24 bp, Homo sapiens
gggtatgatgacattggtggctgc

SEQ ID NO: 18094 - DNA, 24 bp, Homo sapiens
cccctgagacatcctgccctcttt

SEQ ID NO: 18095 - DNA, 24 bp, Homo sapiens
ctagctcagatcaaagagatggtg

SEQ ID NO: 18096 - DNA, 24 bp, Homo sapiens
agcaaccaacagacccaacagcat

SEQ ID NO: 18097 - DNA, 24 bp, Homo sapiens
gctgagaagaatgctcctgccatc

SEQ ID NO: 18098 - DNA, 24 bp, Homo sapiens
gtgagtctgagagcaaccttcgta

SEQ ID NO: 18099 - DNA, 24 bp, Homo sapiens
gttctatggacctcctggctgtgg

SEQ ID NO: 18100 - DNA, 24 bp, Homo sapiens
cgtggaggtaacattggagatggt

SEQ ID NO: 18101 - DNA, 24 bp, Homo sapiens
accgagtcatcaaccagatcctga

SEQ ID NO: 18102 - DNA, 24 bp, Homo sapiens
ctgttttgtaggactttgtgtttt

SEQ ID NO: 18103 - DNA, 24 bp, Homo sapiens
tctgttttgtaggactttgtgttt

SEQ ID NO: 18104 - DNA, 24 bp, Homo sapiens
ttctgttttgtaggactttgtgtt

SEQ ID NO: 18105 - DNA, 24 bp, Homo sapiens
gattacaagtgtgagccaccacgc

SEQ ID NO: 18106 - DNA, 24 bp, Homo sapiens
ttgccaggctagtctcgaactcct

SEQ ID NO: 18107 - DNA, 24 bp, Homo sapiens
aagtgatccacccgtcttggcctc

SEQ ID NO: 18108 - DNA, 24 bp, Homo sapiens
accccacacaggaagctccactgc

SEQ ID NO: 18109 - DNA, 24 bp, Homo sapiens
caccccacacaggaagctccactg

SEQ ID NO: 18110 - DNA, 24 bp, Homo sapiens
ccaccccacacaggaagctccact

SEQ ID NO: 18111 - DNA, 24 bp, Homo sapiens
catcggctggggtgctgggacacc

SEQ ID NO: 18112 - DNA, 24 bp, Homo sapiens
tcatcggctggggtgctgggacac

SEQ ID NO: 18113 - DNA, 24 bp, Homo sapiens
ctcatcggctggggtgctgggaca

SEQ ID NO: 18114 - DNA, 24 bp, Homo sapiens
gcgagacccctaatcgccacgaca

SEQ ID NO: 18115 - DNA, 24 bp, Homo sapiens
agcgagacccctaatcgccacgac

SEQ ID NO: 18116 - DNA, 24 bp, Homo sapiens
cagcgagacccctaatcgccacga

SEQ ID NO: 18117 - DNA, 23 bp, Homo sapiens
gcaacctccgcctcctggattcc

SEQ ID NO: 18118 - DNA, 23 bp, Homo sapiens
ggattacaggtgtgagcctccac

SEQ ID NO: 18119 - DNA, 23 bp, Homo sapiens
ctcctgcctcggcttcccaagta

SEQ ID NO: 18120 - DNA, 24 bp, Homo sapiens
ctgtccaggaagttcaccgagtgg

SEQ ID NO: 18121 - DNA, 25 bp, Homo sapiens
agaagaactcggtgctggaggtgat

SEQ ID NO: 18122 - DNA, 23 bp, Homo sapiens
ctcttggtggagccgctgaaccg

SEQ ID NO: 18123 - DNA, 25 bp, Homo sapiens
ctgtctgtgttaggaggagtctact

SEQ ID NO: 18124 - DNA, 25 bp, Homo sapiens
ttcaacttcctggtctactgcctgt

SEQ ID NO: 18125 - DNA, 23 bp, Homo sapiens
ctcttggtggagccgctgaaccg

SEQ ID NO: 18126 - DNA, 24 bp, Homo sapiens
gcctccgacctctgcttccctgac

SEQ ID NO: 18127 - DNA, 24 bp, Homo sapiens
tgcctccgacctctgcttccctga

SEQ ID NO: 18128 - DNA, 24 bp, Homo sapiens
atgcctccgacctctgcttccctg

SEQ ID NO: 18129 - DNA, 24 bp, Homo sapiens
agactgtccaggtgagctttgcca

SEQ ID NO: 18130 - DNA, 24 bp, Homo sapiens
gagactgtccaggtgagctttgcc

SEQ ID NO: 18131 - DNA, 24 bp, Homo sapiens
tgagactgtccaggtgagctttgc

SEQ ID NO: 18132 - DNA, 24 bp, Homo sapiens
ctccagtaagcagaaacggcagca

SEQ ID NO: 18133 - DNA, 24 bp, Homo sapiens
ccacctccaccatcaacatctatt

SEQ ID NO: 18134 - DNA, 24 bp, Homo sapiens
ccaggagtggagtagacagtccca

SEQ ID NO: 18135 - DNA, 24 bp, Homo sapiens
tcctacttcggcctgaccgggcgg

SEQ ID NO: 18136 - DNA, 24 bp, Homo sapiens
ctcctacttcggcctgaccgggcg

SEQ ID NO: 18137 - DNA, 24 bp, Homo sapiens
cctcctacttcggcctgaccgggc

SEQ ID NO: 18138 - DNA, 24 bp, Homo sapiens
tggcaatccagaaggcaatatggt

SEQ ID NO: 18139 - DNA, 24 bp, Homo sapiens
atcgtatccgtggtggtggtgaca

SEQ ID NO: 18140 - DNA, 24 bp, Homo sapiens
ggagcagcagccagttatttcaaa

SEQ ID NO: 18141 - DNA, 24 bp, Homo sapiens
gccgcctgcaggtggagatcacca

SEQ ID NO: 18142 - DNA, 24 bp, Homo sapiens
ggccgcctgcaggtggagatcacc

SEQ ID NO: 18143 - DNA, 24 bp, Homo sapiens
cggccgcctgcaggtggagatcac

SEQ ID NO: 18144 - DNA, 24 bp, Homo sapiens
atcgtatccgtggtggtggtgaca

SEQ ID NO: 18145 - DNA, 24 bp, Homo sapiens
ggagcagcagccagttatttcaaa

SEQ ID NO: 18146 - DNA, 24 bp, Homo sapiens
accgtgtttatcactgttgtggag

SEQ ID NO: 18147 - DNA, 24 bp, Homo sapiens
tcaatctctggtaatctatgccag

SEQ ID NO: 18148 - DNA, 24 bp, Homo sapiens
ttcaatctctggtaatctatgcca

SEQ ID NO: 18149 - DNA, 24 bp, Homo sapiens
gttcaatctctggtaatctatgcc

SEQ ID NO: 18150 - DNA, 24 bp, Homo sapiens
atccacagatggtcgctgaaaatt

SEQ ID NO: 18151 - DNA, 24 bp, Homo sapiens
gatccacagatggtcgctgaaaat

SEQ ID NO: 18152 - DNA, 24 bp, Homo sapiens
tgatccacagatggtcgctgaaaa

SEQ ID NO: 18153 - DNA, 24 bp, Homo sapiens
cgcagatacgggcttacagatact

SEQ ID NO: 18154 - DNA, 24 bp, Homo sapiens
tcgcagatacgggcttacagatac

SEQ ID NO: 18155 - DNA, 24 bp, Homo sapiens
gtcgcagatacgggcttacagata

SEQ ID NO: 18156 - DNA, 24 bp, Homo sapiens
ggagttcaagaccagcctgcctaa

SEQ ID NO: 18157 - DNA, 24 bp, Homo sapiens
ggagaggctgaggcaggagaatgg

SEQ ID NO: 18158 - DNA, 24 bp, Homo sapiens
ggcagatcacgaggtcaggagatg

SEQ ID NO: 18159 - DNA, 24 bp, Homo sapiens
cagaaagaataatgacagagaagc

SEQ ID NO: 18160 - DNA, 24 bp, Homo sapiens
tcaagtgaatggtacagagtggtc

SEQ ID NO: 18161 - DNA, 24 bp, Homo sapiens
ttgtgttgggcaataggctccatt

SEQ ID NO: 18162 - DNA, 24 bp, Homo sapiens
atcctgatgcttggacaagagtcg

SEQ ID NO: 18163 - DNA, 24 bp, Homo sapiens
ccaaggaaccagtgcgaaggaata

SEQ ID NO: 18164 - DNA, 24 bp, Homo sapiens
catctgacccaacttgtgtagaga

SEQ ID NO: 18165 - DNA, 24 bp, Homo sapiens
tgttagcagaccatgcagctcgtc

SEQ ID NO: 18166 - DNA, 24 bp, Homo sapiens
attagataatgtggtgaattgctt

SEQ ID NO: 18167 - DNA, 24 bp, Homo sapiens
atcctgatgcttggacaagagtcg

SEQ ID NO: 18168 - DNA, 24 bp, Homo sapiens
tgttagcagaccatgcagctcgtc

SEQ ID NO: 18169 - DNA, 24 bp, Homo sapiens
attagataatgtggtgaattgctt

SEQ ID NO: 18170 - DNA, 24 bp, Homo sapiens
actgacacatttaaaggagcatcc

SEQ ID NO: 18171 - DNA, 24 bp, Homo sapiens
actgacacatttaaaggagcatcc

SEQ ID NO: 18172 - DNA, 24 bp, Homo sapiens
ggacaagagtcgacacaattttgg

SEQ ID NO: 18173 - DNA, 24 bp, Homo sapiens
ctgagattgctggtgtgagtgtaa

SEQ ID NO: 18174 - DNA, 24 bp, Homo sapiens
tctcagggaaactcttatggaggc

SEQ ID NO: 18175 - DNA, 24 bp, Homo sapiens
actggaatcatttggctgctgaac

SEQ ID NO: 18176 - DNA, 24 bp, Homo sapiens
tgaatggtacagagtggtcatgga

SEQ ID NO: 18177 - DNA, 24 bp, Homo sapiens
ttgtgttgggcaataggctccatt

SEQ ID NO: 18178 - DNA, 24 bp, Homo sapiens
cagaaagaataatgacagagaagc

SEQ ID NO: 18179 - DNA, 24 bp, Homo sapiens
ggtacagtcagaaggacaggacaa

SEQ ID NO: 18180 - DNA, 24 bp, Homo sapiens
gggtacagtcagaaggacaggaca

SEQ ID NO: 18181 - DNA, 24 bp, Homo sapiens
ggggtacagtcagaaggacaggac

SEQ ID NO: 18182 - DNA, 24 bp, Homo sapiens
acttctttctttacggggagttcc

SEQ ID NO: 18183 - DNA, 24 bp, Homo sapiens
ccgatacgtcacagccttcaatgg

SEQ ID NO: 18184 - DNA, 24 bp, Homo sapiens
ccctccctggcattcgttcgtccc

SEQ ID NO: 18185 - DNA, 24 bp, Homo sapiens
ctcctcagcctctccagtctccag

SEQ ID NO: 18186 - DNA, 24 bp, Homo sapiens
agctgctaccctccaggcttctag

SEQ ID NO: 18187 - DNA, 24 bp, Homo sapiens
ctcctcagcctctccagtctccag

SEQ ID NO: 18188 - DNA, 24 bp, Homo sapiens
agctgctaccctccaggcttctag

SEQ ID NO: 18189 - DNA, 24 bp, Homo sapiens
agccagcgacccggcaggacctag

SEQ ID NO: 18190 - DNA, 24 bp, Homo sapiens
gtgtgaaggaggaggatgagagcg

SEQ ID NO: 18191 - DNA, 24 bp, Homo sapiens
ctcctcagcctctccagtctccag

SEQ ID NO: 18192 - DNA, 24 bp, Homo sapiens
aagggaagaggaagttggatttga

SEQ ID NO: 18193 - DNA, 24 bp, Homo sapiens
accgcgccctgaactgcatgaact

SEQ ID NO: 18194 - DNA, 24 bp, Homo sapiens
aaccgcgccctgaactgcatgaac

SEQ ID NO: 18195 - DNA, 24 bp, Homo sapiens
caaccgcgccctgaactgcatgaa

SEQ ID NO: 18196 - DNA, 24 bp, Homo sapiens
aggtgctgcaggagctagacatga

SEQ ID NO: 18197 - DNA, 24 bp, Homo sapiens
aaggtgctgcaggagctagacatg

SEQ ID NO: 18198 - DNA, 24 bp, Homo sapiens
gaaggtgctgcaggagctagacat

SEQ ID NO: 18199 - DNA, 24 bp, Homo sapiens
tctgtgatcaggagcggtttcaag

SEQ ID NO: 18200 - DNA, 24 bp, Homo sapiens
atctgtgatcaggagcggtttcaa

SEQ ID NO: 18201 - DNA, 24 bp, Homo sapiens
catctgtgatcaggagcggtttca

SEQ ID NO: 18202 - DNA, 24 bp, Homo sapiens
cagcacccaagtcaccgccaaagg

SEQ ID NO: 18203 - DNA, 24 bp, Homo sapiens
ccagcacccaagtcaccgccaaag

SEQ ID NO: 18204 - DNA, 24 bp, Homo sapiens
cccagcacccaagtcaccgccaaa

SEQ ID NO: 18205 - DNA, 24 bp, Homo sapiens
ccgcgccgccccccaagcagcccg

SEQ ID NO: 18206 - DNA, 24 bp, Homo sapiens
gccagtatgacaacgagaagaagt

SEQ ID NO: 18207 - DNA, 24 bp, Homo sapiens
ggagaggttcaaccgcgccctgaa

SEQ ID NO: 18208 - DNA, 24 bp, Homo sapiens
gaacttgcccccagacaaggtcca

SEQ ID NO: 18209 - DNA, 24 bp, Homo sapiens
catcatcacagatctgcggaacca

SEQ ID NO: 18210 - DNA, 24 bp, Homo sapiens
acatcatcacagatctgcggaacc

SEQ ID NO: 18211 - DNA, 24 bp, Homo sapiens
gacatcatcacagatctgcggaac

SEQ ID NO: 18212 - DNA, 22 bp, Homo sapiens
acatccgcgcagacacaggccg

SEQ ID NO: 18213 - DNA, 22 bp, Homo sapiens
cagtgcccgtcggcgtcccccg

SEQ ID NO: 18214 - DNA, 22 bp, Homo sapiens
cccactgcaggtcacctccgac

SEQ ID NO: 18215 - DNA, 24 bp, Homo sapiens
tgagccagtatgacaacgagaaga

SEQ ID NO: 18216 - DNA, 24 bp, Homo sapiens
atgaacttgcccccagacaaggtc

SEQ ID NO: 18217 - DNA, 24 bp, Homo sapiens
cggagagctggaggagaggttcaa

SEQ ID NO: 18218 - DNA, 24 bp, Homo sapiens
aaggagttggagaccctgcgggag

SEQ ID NO: 18219 - DNA, 24 bp, Homo sapiens
ctgaaggtggaggagctggaggag

SEQ ID NO: 18220 - DNA, 24 bp, Homo sapiens
atcctccccgtcgctgtggcaact

SEQ ID NO: 18221 - DNA, 24 bp, Homo sapiens
tccagactaagttccgaatgccac

SEQ ID NO: 18222 - DNA, 24 bp, Homo sapiens
cactgaaacccagccagatcaccg

SEQ ID NO: 18223 - DNA, 24 bp, Homo sapiens
tgcaggagctagacatgagtgatt

SEQ ID NO: 18224 - DNA, 24 bp, Homo sapiens
cactgaaacccagccagatcaccg

SEQ ID NO: 18225 - DNA, 24 bp, Homo sapiens
tccagactaagttccgaatgccac

SEQ ID NO: 18226 - DNA, 24 bp, Homo sapiens
atcctccccgtcgctgtggcaact

SEQ ID NO: 18227 - DNA, 24 bp, Homo sapiens
tgaaacggaggcagcagaaggagc

SEQ ID NO: 18228 - DNA, 24 bp, Homo sapiens
atctgcggaaccagccctacatcc

SEQ ID NO: 18229 - DNA, 24 bp, Homo sapiens
gtcacctccgacctctcgctgtag

SEQ ID NO: 18230 - DNA, 24 bp, Homo sapiens
tacagcgacaggtaagtttcagat

SEQ ID NO: 18231 - DNA, 24 bp, Homo sapiens
gtacagcgacaggtaagtttcaga

SEQ ID NO: 18232 - DNA, 24 bp, Homo sapiens
tgtacagcgacaggtaagtttcag

SEQ ID NO: 18233 - DNA, 24 bp, Homo sapiens
cgtgggctttaccatgagtaactc

SEQ ID NO: 18234 - DNA, 24 bp, Homo sapiens
cccatttgaacaagcaaagaaggt

SEQ ID NO: 18235 - DNA, 24 bp, Homo sapiens
gcgatacgacgaaatggtggagtc

SEQ ID NO: 18236 - DNA, 24 bp, Homo sapiens
agcgatacgacgaaatggtggagt

SEQ ID NO: 18237 - DNA, 24 bp, Homo sapiens
gagcgatacgacgaaatggtggag

SEQ ID NO: 18238 - DNA, 24 bp, Homo sapiens
gtgccagatgtggcaagatcacca

SEQ ID NO: 18239 - DNA, 24 bp, Homo sapiens
aagtagcagggatggatgtggagc

SEQ ID NO: 18240 - DNA, 24 bp, Homo sapiens
cctggagaataatcagcagcattg

SEQ ID NO: 18241 - DNA, 24 bp, Homo sapiens
atcggcaaatggttgagactgagc

SEQ ID NO: 18242 - DNA, 25 bp, Homo sapiens
gttggtaaggctggtcttgaactcc

SEQ ID NO: 18243 - DNA, 23 bp, Homo sapiens
gattctcctgcctcggcctcctg

SEQ ID NO: 18244 - DNA, 23 bp, Homo sapiens
gatgatccacccgcctcggcctc

SEQ ID NO: 18245 - DNA, 25 bp, Homo sapiens
atgttgccaggagaagatgagccac

SEQ ID NO: 18246 - DNA, 24 bp, Homo sapiens
tgtgaaagaagggaaggttgggcg

SEQ ID NO: 18247 - DNA, 25 bp, Homo sapiens
cctggttactgccaatacaatggag

SEQ ID NO: 18248 - DNA, 24 bp, Homo sapiens
gagcggcacaacctcatcacagag

SEQ ID NO: 18249 - DNA, 23 bp, Homo sapiens
ggcttaacacccgagagttccgc

SEQ ID NO: 18250 - DNA, 25 bp, Homo sapiens
ccctgagcccatctacaatagcgag

SEQ ID NO: 18251 - DNA, 24 bp, Homo sapiens
agtttgttgggtgaactttgaggc

SEQ ID NO: 18252 - DNA, 24 bp, Homo sapiens
gagtttgttgggtgaactttgagg

SEQ ID NO: 18253 - DNA, 24 bp, Homo sapiens
ggagtttgttgggtgaactttgag

SEQ ID NO: 18254 - DNA, 24 bp, Homo sapiens
ctagatttgaaaacaactaaagcg

SEQ ID NO: 18255 - DNA, 24 bp, Homo sapiens
gcctgtttaaagaagaaaacccgt

SEQ ID NO: 18256 - DNA, 24 bp, Homo sapiens
cacatcagtcccgacgcttcctgt

SEQ ID NO: 18257 - DNA, 24 bp, Homo sapiens
acccgtatgctagatttgaaaaca

SEQ ID NO: 18258 - DNA, 24 bp, Homo sapiens
cacgtggccattgcggtctcctga

SEQ ID NO: 18259 - DNA, 24 bp, Homo sapiens
gtgatccacctgcctcagcctcgc

SEQ ID NO: 18260 - DNA, 24 bp, Homo sapiens
gtgtcggccaggctggtctcaaac

SEQ ID NO: 18261 - DNA, 24 bp, Homo sapiens
ccgtgccactggtgaatagggatt

SEQ ID NO: 18262 - DNA, 24 bp, Homo sapiens
agagttgagtcagaccagtaagcc

SEQ ID NO: 18263 - DNA, 24 bp, Homo sapiens
tgcgtgttaatggctgttcgagag

SEQ ID NO: 18264 - DNA, 24 bp, Homo sapiens
tcaagcgattctcctgccttagcc

SEQ ID NO: 18265 - DNA, 24 bp, Homo sapiens
gtagctgcgattacaggcacctgc

SEQ ID NO: 18266 - DNA, 24 bp, Homo sapiens
acccagctcatttttgtatttttt

SEQ ID NO: 18267 - DNA, 24 bp, Homo sapiens
caacctccgcctcccagattcaat

SEQ ID NO: 18268 - DNA, 24 bp, Homo sapiens
ggctggagtgcaatggcgtgatct

SEQ ID NO: 18269 - DNA, 24 bp, Homo sapiens
tcctgtctcagcttcccaagtagc

SEQ ID NO: 18270 - DNA, 24 bp, Homo sapiens
ccgctacggagctccagcccttct

SEQ ID NO: 18271 - DNA, 24 bp, Homo sapiens
tccgctacggagctccagcccttc

SEQ ID NO: 18272 - DNA, 24 bp, Homo sapiens
gtccgctacggagctccagccctt

SEQ ID NO: 18273 - DNA, 24 bp, Homo sapiens
gctcagagtgtgaccaactggaac

SEQ ID NO: 18274 - DNA, 24 bp, Homo sapiens
tgaatttccctgctgttccctccc

SEQ ID NO: 18275 - DNA, 24 bp, Homo sapiens
atgcagatgtgatgactagagcca

SEQ ID NO: 18276 - DNA, 24 bp, Homo sapiens
ctccacttcccaggttcaagcaat

SEQ ID NO: 18277 - DNA, 24 bp, Homo sapiens
aagtgcagtggtgtcacctcggct

SEQ ID NO: 18278 - DNA, 24 bp, Homo sapiens
ggagcccctgcctccctcggtgcg

SEQ ID NO: 18279 - DNA, 24 bp, Homo sapiens
ccgccggaggagcccccgcccctg

SEQ ID NO: 18280 - DNA, 24 bp, Homo sapiens
cttgcagcctcggacgcgcggcga

SEQ ID NO: 18281 - DNA, 24 bp, Homo sapiens
cccggggccaggcagcctgcccta

SEQ ID NO: 18282 - DNA, 24 bp, Homo sapiens
gcccggggccaggcagcctgccct

SEQ ID NO: 18283 - DNA, 24 bp, Homo sapiens
agcccggggccaggcagcctgccc

SEQ ID NO: 18284 - DNA, 24 bp, Homo sapiens
agttcaagcgatcctcctgcctcc

SEQ ID NO: 18285 - DNA, 24 bp, Homo sapiens
agtggtgcgatctcggcttactgc

SEQ ID NO: 18286 - DNA, 24 bp, Homo sapiens
cgccaacctcagcctcccaaagtg

SEQ ID NO: 18287 - DNA, 24 bp, Homo sapiens
atgtggctgtggatttcacccagg

SEQ ID NO: 18288 - DNA, 24 bp, Homo sapiens
gagaggtgatgctggagaactaca

SEQ ID NO: 18289 - DNA, 24 bp, Homo sapiens
tgctgagccctgctcaaaggactc

SEQ ID NO: 18290 - DNA, 24 bp, Homo sapiens
agtttctggagaaagcatcaaaac

SEQ ID NO: 18291 - DNA, 24 bp, Homo sapiens
gagtttctggagaaagcatcaaaa

SEQ ID NO: 18292 - DNA, 24 bp, Homo sapiens
cgagtttctggagaaagcatcaaa

SEQ ID NO: 18293 - DNA, 24 bp, Homo sapiens
gctcacatccgaactcaacatctc

SEQ ID NO: 18294 - DNA, 24 bp, Homo sapiens
ccaaggtgctggagaccttcctgg

SEQ ID NO: 18295 - DNA, 24 bp, Homo sapiens
acagcattcctttccttgaagtct

SEQ ID NO: 18296 - DNA, 24 bp, Homo sapiens
tggaggaatcggatggcataagtg

SEQ ID NO: 18297 - DNA, 24 bp, Homo sapiens
gtgatctggcgggatgggcgtttg

SEQ ID NO: 18298 - DNA, 24 bp, Homo sapiens
cggaggaggaaagagaaccagggc

SEQ ID NO: 18299 - DNA, 24 bp, Homo sapiens
tcggaggaggaaagagaaccaggg

SEQ ID NO: 18300 - DNA, 24 bp, Homo sapiens
atcggaggaggaaagagaaccagg

SEQ ID NO: 18301 - DNA, 24 bp, Homo sapiens
gtctccaacagccttcgccgcctg

SEQ ID NO: 18302 - DNA, 24 bp, Homo sapiens
tgtctccaacagccttcgccgcct

SEQ ID NO: 18303 - DNA, 24 bp, Homo sapiens
ctgtctccaacagccttcgccgcc

SEQ ID NO: 18304 - DNA, 24 bp, Homo sapiens
ctctgtggcagaggcaaatacctc

SEQ ID NO: 18305 - DNA, 24 bp, Homo sapiens
tctctgtggcagaggcaaatacct

SEQ ID NO: 18306 - DNA, 24 bp, Homo sapiens
ctctctgtggcagaggcaaatacc

SEQ ID NO: 18307 - DNA, 24 bp, Homo sapiens
acctcacaagtccacggacctcac

SEQ ID NO: 18308 - DNA, 24 bp, Homo sapiens
cacctcacaagtccacggacctca

SEQ ID NO: 18309 - DNA, 24 bp, Homo sapiens
acacctcacaagtccacggacctc

SEQ ID NO: 18310 - DNA, 24 bp, Homo sapiens
tgtggacacaggtgggcagccctg

SEQ ID NO: 18311 - DNA, 24 bp, Homo sapiens
atgtggacacaggtgggcagccct

SEQ ID NO: 18312 - DNA, 24 bp, Homo sapiens
gatgtggacacaggtgggcagccc

SEQ ID NO: 18313 - DNA, 24 bp, Homo sapiens
agaggggacaggtaggtccacgga

SEQ ID NO: 18314 - DNA, 24 bp, Homo sapiens
aagaggggacaggtaggtccacgg

SEQ ID NO: 18315 - DNA, 24 bp, Homo sapiens
gaagaggggacaggtaggtccacg

SEQ ID NO: 18316 - DNA, 24 bp, Homo sapiens
tactccgacagcgagcactacctc

SEQ ID NO: 18317 - DNA, 25 bp, Homo sapiens
ccaacagccagcctaactctcagtc

SEQ ID NO: 18318 - DNA, 23 bp, Homo sapiens
cccagcgtgcccaggagatgttc

SEQ ID NO: 18319 - DNA, 24 bp, Homo sapiens
gaggcggcaacaacagattgaacg

SEQ ID NO: 18320 - DNA, 25 bp, Homo sapiens
caaagaaagggaacgggtggagaac

SEQ ID NO: 18321 - DNA, 23 bp, Homo sapiens
ccttgtgctgggtgtgctgtcag

SEQ ID NO: 18322 - DNA, 24 bp, Homo sapiens
tcatgttcatcttcgccgtggtgg

SEQ ID NO: 18323 - DNA, 25 bp, Homo sapiens
cgtcttcaacatcctcatcgtctac

SEQ ID NO: 18324 - DNA, 25 bp, Homo sapiens
aggctgtgtttgactgtgtggtgaa

SEQ ID NO: 18325 - DNA, 25 bp, Homo sapiens
caacaccgtccacttcaattccacc

SEQ ID NO: 18326 - DNA, 23 bp, Homo sapiens
atccgcacagccctggacatcaa

SEQ ID NO: 18327 - DNA, 23 bp, Homo sapiens
caagggaggagccgacaaacagc

SEQ ID NO: 18328 - DNA, 25 bp, Homo sapiens
acttgaggaatggctggaatgtcat

SEQ ID NO: 18329 - DNA, 24 bp, Homo sapiens
tcattgcccttgggtttgccttcc

SEQ ID NO: 18330 - DNA, 25 bp, Homo sapiens
tggaattttttgtttcgaggctgga

SEQ ID NO: 18331 - DNA, 25 bp, Homo sapiens
acttgaggaatggctggaatgtcat

SEQ ID NO: 18332 - DNA, 24 bp, Homo sapiens
tcattgcccttgggtttgccttcc

SEQ ID NO: 18333 - DNA, 24 bp, Homo sapiens
tgaacggctggatgacacagaacc

SEQ ID NO: 18334 - DNA, 25 bp, Homo sapiens
gggacagatgacattcagggtgagt

SEQ ID NO: 18335 - DNA, 24 bp, Homo sapiens
aacgatgcctcagggaacacttgg

SEQ ID NO: 18336 - DNA, 23 bp, Homo sapiens
ccttgtgctgggtgtgctgtcag

SEQ ID NO: 18337 - DNA, 25 bp, Homo sapiens
cagttgggacggagtttgacctacg

SEQ ID NO: 18338 - DNA, 25 bp, Homo sapiens
acttgaggaatggctggaatgtcat

SEQ ID NO: 18339 - DNA, 24 bp, Homo sapiens
tgaacggctggatgacacagaacc

SEQ ID NO: 18340 - DNA, 24 bp, Homo sapiens
aacgatgcctcagggaacacttgg

SEQ ID NO: 18341 - DNA, 23 bp, Homo sapiens
ccttgtgctgggtgtgctgtcag

SEQ ID NO: 18342 - DNA, 25 bp, Homo sapiens
caaagaaagggaacgggtggagaac

SEQ ID NO: 18343 - DNA, 24 bp, Homo sapiens
gaggcggcaacaacagattgaacg

SEQ ID NO: 18344 - DNA, 25 bp, Homo sapiens
gctctgcggagaaccaccataaaga

SEQ ID NO: 18345 - DNA, 23 bp, Homo sapiens
ccttcgcccgagccagcattaaa

SEQ ID NO: 18346 - DNA, 24 bp, Homo sapiens
gaggcggcaacaacagattgaacg

SEQ ID NO: 18347 - DNA, 23 bp, Homo sapiens
ggtggagaaccggcgggcttttc

SEQ ID NO: 18348 - DNA, 25 bp, Homo sapiens
gctctgcggagaaccaccataaaga

SEQ ID NO: 18349 - DNA, 23 bp, Homo sapiens
ccttcgcccgagccagcattaaa

SEQ ID NO: 18350 - DNA, 23 bp, Homo sapiens
ttctacatccgccgcatggtcaa

SEQ ID NO: 18351 - DNA, 25 bp, Homo sapiens
tcaccaaggacgagcaagaggaaga

SEQ ID NO: 18352 - DNA, 23 bp, Homo sapiens
caaggaggtggcagaagtgagtc

SEQ ID NO: 18353 - DNA, 23 bp, Homo sapiens
cagcggaccagtgagatgcgaaa

SEQ ID NO: 18354 - DNA, 23 bp, Homo sapiens
gtgcctacttccgtgacctctgg

SEQ ID NO: 18355 - DNA, 24 bp, Homo sapiens
ccctggtagcctttgccttcactg

SEQ ID NO: 18356 - DNA, 25 bp, Homo sapiens
aaggctgtgtttgactgtgtggtga

SEQ ID NO: 18357 - DNA, 23 bp, Homo sapiens
gccctaagccaatgcctccctat

SEQ ID NO: 18358 - DNA, 24 bp, Homo sapiens
gaaggaggaggaggaagacgaccg

SEQ ID NO: 18359 - DNA, 24 bp, Homo sapiens
cctcaaccacaccgtcgtacaagt

SEQ ID NO: 18360 - DNA, 25 bp, Homo sapiens
tggaggacgaggacagtgatgaaga

SEQ ID NO: 18361 - DNA, 24 bp, Homo sapiens
aatcactgagcacaataacttccg

SEQ ID NO: 18362 - DNA, 23 bp, Homo sapiens
agaacgccctcccctccacccag

SEQ ID NO: 18363 - DNA, 23 bp, Homo sapiens
ccccgtccccaacgcaggaaggg

SEQ ID NO: 18364 - DNA, 25 bp, Homo sapiens
cctcagtaccatctcagacaccagc

SEQ ID NO: 18365 - DNA, 23 bp, Homo sapiens
gaggagaaccagcggcaccacca

SEQ ID NO: 18366 - DNA, 23 bp, Homo sapiens
ggacagacctgagcatgaccacc

SEQ ID NO: 18367 - DNA, 23 bp, Homo sapiens
ccaccaccaccaccaccaccatc

SEQ ID NO: 18368 - DNA, 23 bp, Homo sapiens
caaggaccgctatgcccaggaac

SEQ ID NO: 18369 - DNA, 24 bp, Homo sapiens
caaggatcggaagcatcgacagca

SEQ ID NO: 18370 - DNA, 24 bp, Homo sapiens
ggtactacaaggctgcaaggtgtg

SEQ ID NO: 18371 - DNA, 24 bp, Homo sapiens
tggtactacaaggctgcaaggtgt

SEQ ID NO: 18372 - DNA, 24 bp, Homo sapiens
ttggtactacaaggctgcaaggtg

SEQ ID NO: 18373 - DNA, 25 bp, Homo sapiens
cacctgcctttcttccttctcccac

SEQ ID NO: 18374 - DNA, 25 bp, Homo sapiens
gtccaacagcagcctactaaaccag

SEQ ID NO: 18375 - DNA, 25 bp, Homo sapiens
ggtagaatgaatgtggcaggagacg

SEQ ID NO: 18376 - DNA, 25 bp, Homo sapiens
aggaggttcgagatcacatgcagga

SEQ ID NO: 18377 - DNA, 25 bp, Homo sapiens
aacttgtactggttgccgaacacag

SEQ ID NO: 18378 - DNA, 25 bp, Homo sapiens
tggagccatattgttcaactgcttg

SEQ ID NO: 18379 - DNA, 24 bp, Homo sapiens
aagaactcgatggtgttgtgagag

SEQ ID NO: 18380 - DNA, 25 bp, Homo sapiens
tgccagacgtttaggattgagatgt

SEQ ID NO: 18381 - DNA, 25 bp, Homo sapiens
tgcaactattgttctcagctatgta

SEQ ID NO: 18382 - DNA, 24 bp, Homo sapiens
aatgccaccaggtatgcccccacc

SEQ ID NO: 18383 - DNA, 24 bp, Homo sapiens
gaatgccaccaggtatgcccccac

SEQ ID NO: 18384 - DNA, 24 bp, Homo sapiens
ggaatgccaccaggtatgccccca

SEQ ID NO: 18385 - DNA, 24 bp, Homo sapiens
gcacagcacaagctcaggcagctg

SEQ ID NO: 18386 - DNA, 24 bp, Homo sapiens
agcacagcacaagctcaggcagct

SEQ ID NO: 18387 - DNA, 24 bp, Homo sapiens
tagcacagcacaagctcaggcagc

SEQ ID NO: 18388 - DNA, 24 bp, Homo sapiens
atgccacctggattgcatcatcag

SEQ ID NO: 18389 - DNA, 24 bp, Homo sapiens
catgccacctggattgcatcatca

SEQ ID NO: 18390 - DNA, 24 bp, Homo sapiens
gcatgccacctggattgcatcatc

SEQ ID NO: 18391 - DNA, 25 bp, Homo sapiens
accaggaataccacctctgatgcct

SEQ ID NO: 18392 - DNA, 24 bp, Homo sapiens
ctctgatgccaggaatgccaccag

SEQ ID NO: 18393 - DNA, 24 bp, Homo sapiens
gcatacctccattaatgccaggtg

SEQ ID NO: 18394 - DNA, 23 bp, Homo sapiens
caccagtaccaggagcaccagga

SEQ ID NO: 18395 - DNA, 24 bp, Homo sapiens
tgccaggaatgccaccagttatgc

SEQ ID NO: 18396 - DNA, 25 bp, Homo sapiens
accaggaataccacctctgatgcct

SEQ ID NO: 18397 - DNA, 25 bp, Homo sapiens
cctggaagaacagacatagagttgg

SEQ ID NO: 18398 - DNA, 25 bp, Homo sapiens
gccgtggtgctggtattgtaataga

SEQ ID NO: 18399 - DNA, 25 bp, Homo sapiens
cggtagaacacagttatgggtcgca

SEQ ID NO: 18400 - DNA, 25 bp, Homo sapiens
ccacagcctccagttactaagcctc

SEQ ID NO: 18401 - DNA, 24 bp, Homo sapiens
ccacctgcaccaacagcaactgta

SEQ ID NO: 18402 - DNA, 23 bp, Homo sapiens
ctgtttcagcgccaggtattctt

SEQ ID NO: 18403 - DNA, 22 bp, Homo sapiens
gaaatgacaagccacatcgatg

SEQ ID NO: 18404 - DNA, 24 bp, Homo sapiens
cgaaatgacaagccacatcgatgt

SEQ ID NO: 18405 - DNA, 24 bp, Homo sapiens
gcgaaatgacaagccacatcgatg

SEQ ID NO: 18406 - DNA, 24 bp, Homo sapiens
ttcaacagacggaagcccaagcca

SEQ ID NO: 18407 - DNA, 24 bp, Homo sapiens
tgagcatcacagtgggcatcaacc

SEQ ID NO: 18408 - DNA, 24 bp, Homo sapiens
cctcaagccagccgagctcccagg

SEQ ID NO: 18409 - DNA, 24 bp, Homo sapiens
gaaatgacaagccacatcgatgtg

SEQ ID NO: 18410 - DNA, 24 bp, Homo sapiens
cgaaatgacaagccacatcgatgt

SEQ ID NO: 18411 - DNA, 24 bp, Homo sapiens
gcgaaatgacaagccacatcgatg

SEQ ID NO: 18412 - DNA, 24 bp, Homo sapiens
tcctacctgccctgtgtgtaacaa

SEQ ID NO: 18413 - DNA, 24 bp, Homo sapiens
cacgagcgaaatgacaagccacat

SEQ ID NO: 18414 - DNA, 24 bp, Homo sapiens
aagaatcccagtttcaacgccaca

SEQ ID NO: 18415 - DNA, 23 bp, Homo sapiens
gaagagcgagccagcgcccggag

SEQ ID NO: 18416 - DNA, 24 bp, Homo sapiens
aatcaccctgggtgagccctgcct

SEQ ID NO: 18417 - DNA, 24 bp, Homo sapiens
gaatcaccctgggtgagccctgcc

SEQ ID NO: 18418 - DNA, 24 bp, Homo sapiens
ggaatcaccctgggtgagccctgc

SEQ ID NO: 18419 - DNA, 24 bp, Homo sapiens
tcagagatccgtgtgctggtccag

SEQ ID NO: 18420 - DNA, 24 bp, Homo sapiens
atcagagatccgtgtgctggtcca

SEQ ID NO: 18421 - DNA, 24 bp, Homo sapiens
aatcagagatccgtgtgctggtcc

SEQ ID NO: 18422 - DNA, 24 bp, Homo sapiens
tgaaagatcagtttggcttcatta

SEQ ID NO: 18423 - DNA, 24 bp, Homo sapiens
gtgaaagatcagtttggcttcatt

SEQ ID NO: 18424 - DNA, 24 bp, Homo sapiens
tgtgaaagatcagtttggcttcat

SEQ ID NO: 18425 - DNA, 25 bp, Homo sapiens
ctacaggcaggagatgaggtggagt

SEQ ID NO: 18426 - DNA, 25 bp, Homo sapiens
gaagtaggagatagcaagaagctct

SEQ ID NO: 18427 - DNA, 23 bp, Homo sapiens
atgtgaaagaagttcaggatggc

SEQ ID NO: 18428 - DNA, 25 bp, Homo sapiens
cgtgacaaattagagcgagcaacca

SEQ ID NO: 18429 - DNA, 24 bp, Homo sapiens
gctggaaggtgaccatgttaggtt

SEQ ID NO: 18430 - DNA, 25 bp, Homo sapiens
gagacaaagatacgaaatccaaggt

SEQ ID NO: 18431 - DNA, 25 bp, Homo sapiens
ggctcttgggttatgtggcaactct

SEQ ID NO: 18432 - DNA, 25 bp, Homo sapiens
tctctggtgatgttgatagcctgga

SEQ ID NO: 18433 - DNA, 25 bp, Homo sapiens
tccaaaggcaaaggcaacaaagtca

SEQ ID NO: 18434 - DNA, 25 bp, Homo sapiens
ccaacacagactgagtaccaaggaa

SEQ ID NO: 18435 - DNA, 25 bp, Homo sapiens
tccaaaggcaaaggcaacaaagtca

SEQ ID NO: 18436 - DNA, 25 bp, Homo sapiens
tctctggtgatgttgatagcctgga

SEQ ID NO: 18437 - DNA, 24 bp, Homo sapiens
ggtgatccttcgacctctgcctcc

SEQ ID NO: 18438 - DNA, 24 bp, Homo sapiens
gctcactgcagctttgacctcctt

SEQ ID NO: 18439 - DNA, 23 bp, Homo sapiens
tgatctgcccaccttgacctccc

SEQ ID NO: 18440 - DNA, 23 bp, Homo sapiens
ggccaggctggtctcgaattcct

SEQ ID NO: 18441 - DNA, 23 bp, Homo sapiens
ggcaacctgacgctggtgctggc

SEQ ID NO: 18442 - DNA, 23 bp, Homo sapiens
gagggacccctccatccactaca

SEQ ID NO: 18443 - DNA, 23 bp, Homo sapiens
ccacgttggcctttgtcctggcc

SEQ ID NO: 18444 - DNA, 24 bp, Homo sapiens
acaaggccgcggtcctggaccgga

SEQ ID NO: 18445 - DNA, 24 bp, Homo sapiens
gacaaggccgcggtcctggaccgg

SEQ ID NO: 18446 - DNA, 24 bp, Homo sapiens
tgacaaggccgcggtcctggaccg

SEQ ID NO: 18447 - DNA, 23 bp, Homo sapiens
agttcgccagccaacgcctccac

SEQ ID NO: 18448 - DNA, 23 bp, Homo sapiens
ctcttccgttccgtccgctccaa

SEQ ID NO: 18449 - DNA, 24 bp, Homo sapiens
gacatcttcctcacgcccaacaaa

SEQ ID NO: 18450 - DNA, 23 bp, Homo sapiens
tacttctccgccttcccaccacc

SEQ ID NO: 18451 - DNA, 25 bp, Homo sapiens
gagaaacacttgccgtccttacagc

SEQ ID NO: 18452 - DNA, 24 bp, Homo sapiens
tgagtcatacccaggcaagtgctt

SEQ ID NO: 18453 - DNA, 25 bp, Homo sapiens
gagaaacacttgccgtccttacagc

SEQ ID NO: 18454 - DNA, 24 bp, Homo sapiens
tgagtcatacccaggcaagtgctt

SEQ ID NO: 18455 - DNA, 23 bp, Homo sapiens
cccaagtatcggcttcccatcga

SEQ ID NO: 18456 - DNA, 25 bp, Homo sapiens
tggttggtggtcatcatctacttgt

SEQ ID NO: 18457 - DNA, 23 bp, Homo sapiens
tacttctccgccttcccaccacc

SEQ ID NO: 18458 - DNA, 25 bp, Homo sapiens
gagaaacacttgccgtccttacagc

SEQ ID NO: 18459 - DNA, 25 bp, Homo sapiens
agtttcacctttctccagtccagca

SEQ ID NO: 18460 - DNA, 25 bp, Homo sapiens
aagagatgactgctcagatggagag

SEQ ID NO: 18461 - DNA, 24 bp, Homo sapiens
gctggaacaggatctacaggtctt

SEQ ID NO: 18462 - DNA, 25 bp, Homo sapiens
acttgatgttgctggtctggtgtct

SEQ ID NO: 18463 - DNA, 25 bp, Homo sapiens
gccaacaagactcctaatagcctca

SEQ ID NO: 18464 - DNA, 24 bp, Homo sapiens
acagccacaacacttggattcctg

SEQ ID NO: 18465 - DNA, 25 bp, Homo sapiens
acttgatgttgctggtctggtgtct

SEQ ID NO: 18466 - DNA, 25 bp, Homo sapiens
aggacatcagggagccaacaagact

SEQ ID NO: 18467 - DNA, 24 bp, Homo sapiens
acagccacaacacttggattcctg

SEQ ID NO: 18468 - DNA, 24 bp, Homo sapiens
gatcctcccacctgtcctcccaaa

SEQ ID NO: 18469 - DNA, 24 bp, Homo sapiens
cgatcctcccacctgtcctcccaa

SEQ ID NO: 18470 - DNA, 24 bp, Homo sapiens
gcgatcctcccacctgtcctccca

SEQ ID NO: 18471 - DNA, 24 bp, Homo sapiens
gatcctcccacctgtaatcccagc

SEQ ID NO: 18472 - DNA, 24 bp, Homo sapiens
cgatcctcccacctgtaatcccag

SEQ ID NO: 18473 - DNA, 24 bp, Homo sapiens
gcgatcctcccacctgtaatccca

SEQ ID NO: 18474 - DNA, 24 bp, Homo sapiens
ttcatcctcagctcaccgggatta

SEQ ID NO: 18475 - DNA, 24 bp, Homo sapiens
attcatcctcagctcaccgggatt

SEQ ID NO: 18476 - DNA, 24 bp, Homo sapiens
gattcatcctcagctcaccgggat

SEQ ID NO: 18477 - DNA, 23 bp, Homo sapiens
cctgccgcctgggcctccacacc

SEQ ID NO: 18478 - DNA, 25 bp, Homo sapiens
agattcatcctccttcaatgcctgg

SEQ ID NO: 18479 - DNA, 25 bp, Homo sapiens
tgggtcagaaattcagggaagcaat

SEQ ID NO: 18480 - DNA, 25 bp, Homo sapiens
gtgaccagtgatgacacgggaatgt

SEQ ID NO: 18481 - DNA, 24 bp, Homo sapiens
ttgatggcaaggcgcggtggctca

SEQ ID NO: 18482 - DNA, 24 bp, Homo sapiens
tttgatggcaaggcgcggtggctc

SEQ ID NO: 18483 - DNA, 24 bp, Homo sapiens
atttgatggcaaggcgcggtggct

SEQ ID NO: 18484 - DNA, 24 bp, Homo sapiens
gaggaagaggacgaggacgacgag

SEQ ID NO: 18485 - DNA, 24 bp, Homo sapiens
gaaatgcccggtcccagagaggag

SEQ ID NO: 18486 - DNA, 24 bp, Homo sapiens
cccacccagcccgcgtccgagaaa

SEQ ID NO: 18487 - DNA, 25 bp, Homo sapiens
tgttggtcacgctggtcttgaactc

SEQ ID NO: 18488 - DNA, 23 bp, Homo sapiens
tcaggtgatctgcctcaggcccg

SEQ ID NO: 18489 - DNA, 23 bp, Homo sapiens
tcacgcccggccaggggatgttt

SEQ ID NO: 18490 - DNA, 24 bp, Homo sapiens
gcaatctcggctcaccacaacctt

SEQ ID NO: 18491 - DNA, 23 bp, Homo sapiens
caattctcctgccacagcctctc

SEQ ID NO: 18492 - DNA, 24 bp, Homo sapiens
atgccgcgcaggtgagccgggggc

SEQ ID NO: 18493 - DNA, 24 bp, Homo sapiens
gatgccgcgcaggtgagccggggg

SEQ ID NO: 18494 - DNA, 24 bp, Homo sapiens
cgatgccgcgcaggtgagccgggg

SEQ ID NO: 18495 - DNA, 23 bp, Homo sapiens
caatttgcctgcctcggccttcc

SEQ ID NO: 18496 - DNA, 24 bp, Homo sapiens
tccgtcagaagtccagcatgagtg

SEQ ID NO: 18497 - DNA, 24 bp, Homo sapiens
atccgtcagaagtccagcatgagt

SEQ ID NO: 18498 - DNA, 24 bp, Homo sapiens
catccgtcagaagtccagcatgag

SEQ ID NO: 18499 - DNA, 25 bp, Homo sapiens
aagatgatgaggtggagacagcagc

SEQ ID NO: 18500 - DNA, 23 bp, Homo sapiens
ttcgtgacttcctgctcaagcca

SEQ ID NO: 18501 - DNA, 24 bp, Homo sapiens
gagcatccgtcagaagtccagcat

SEQ ID NO: 18502 - DNA, 23 bp, Homo sapiens
ttcgtgacttcctgctcaagcca

SEQ ID NO: 18503 - DNA, 23 bp, Homo sapiens
ggctcctatgtctccatccacag

SEQ ID NO: 18504 - DNA, 25 bp, Homo sapiens
aagatgatgaggtggagacagcagc

SEQ ID NO: 18505 - DNA, 25 bp, Homo sapiens
gaagaggtgctgaagaagaactgcc

SEQ ID NO: 18506 - DNA, 23 bp, Homo sapiens
cgtccagtctgccgcaagttcat

SEQ ID NO: 18507 - DNA, 25 bp, Homo sapiens
gatgatgagacgaagttgacgctgc

SEQ ID NO: 18508 - DNA, 24 bp, Homo sapiens
tggatgatgagacgaagttgacgc

SEQ ID NO: 18509 - DNA, 24 bp, Homo sapiens
gtggatgatgagacgaagttgacg

SEQ ID NO: 18510 - DNA, 24 bp, Homo sapiens
cgtggatgatgagacgaagttgac

SEQ ID NO: 18511 - DNA, 24 bp, Homo sapiens
gagcatccgtcagaagtccagcat

SEQ ID NO: 18512 - DNA, 24 bp, Homo sapiens
aggtgtctgtgctggtgatgtgtc

SEQ ID NO: 18513 - DNA, 25 bp, Homo sapiens
atgcccaatgtcaaggttgctgttt

SEQ ID NO: 18514 - DNA, 24 bp, Homo sapiens
gagcatccgtcagaagtccagcat

SEQ ID NO: 18515 - DNA, 23 bp, Homo sapiens
ttcgtgacttcctgctcaagcca

SEQ ID NO: 18516 - DNA, 23 bp, Homo sapiens
ggctcctatgtctccatccacag

SEQ ID NO: 18517 - DNA, 25 bp, Homo sapiens
tggactatgaagatgatgaggtgga

SEQ ID NO: 18518 - DNA, 25 bp, Homo sapiens
atggcagagaacgatgtggacaatg

SEQ ID NO: 18519 - DNA, 23 bp, Homo sapiens
gctgggggagatggggctgaggc

SEQ ID NO: 18520 - DNA, 24 bp, Homo sapiens
aggatgtcaagggctcctatgtct

SEQ ID NO: 18521 - DNA, 24 bp, Homo sapiens
aaggatgtcaagggctcctatgtc

SEQ ID NO: 18522 - DNA, 24 bp, Homo sapiens
gaaggatgtcaagggctcctatgt

SEQ ID NO: 18523 - DNA, 25 bp, Homo sapiens
cagttatggcagagaacgatgtgga

SEQ ID NO: 18524 - DNA, 23 bp, Homo sapiens
ccctgccaagaaggatgtcaagg

SEQ ID NO: 18525 - DNA, 25 bp, Homo sapiens
gctcttggactatgaagatgatgag

SEQ ID NO: 18526 - DNA, 24 bp, Homo sapiens
gtctccatccacagctctggcttt

SEQ ID NO: 18527 - DNA, 24 bp, Homo sapiens
tgtctccatccacagctctggctt

SEQ ID NO: 18528 - DNA, 24 bp, Homo sapiens
atgtctccatccacagctctggct

SEQ ID NO: 18529 - DNA, 24 bp, Homo sapiens
acaatgagctcttggactatgaag

SEQ ID NO: 18530 - DNA, 24 bp, Homo sapiens
gacaatgagctcttggactatgaa

SEQ ID NO: 18531 - DNA, 24 bp, Homo sapiens
ggacaatgagctcttggactatga

SEQ ID NO: 18532 - DNA, 24 bp, Homo sapiens
tccacagctctggctttcgtgact

SEQ ID NO: 18533 - DNA, 24 bp, Homo sapiens
atccacagctctggctttcgtgac

SEQ ID NO: 18534 - DNA, 24 bp, Homo sapiens
catccacagctctggctttcgtga

SEQ ID NO: 18535 - DNA, 24 bp, Homo sapiens
ttctgggaatggatgtcctgtgcc

SEQ ID NO: 18536 - DNA, 23 bp, Homo sapiens
gtcgggcatgggaaagacagcag

SEQ ID NO: 18537 - DNA, 23 bp, Homo sapiens
tcttggccacactgcaacagctg

SEQ ID NO: 18538 - DNA, 25 bp, Homo sapiens
tggcagagaacgatgtggacaatga

SEQ ID NO: 18539 - DNA, 25 bp, Homo sapiens
aagatgatgaggtggagacagcagc

SEQ ID NO: 18540 - DNA, 23 bp, Homo sapiens
ggctcctatgtctccatccacag

SEQ ID NO: 18541 - DNA, 24 bp, Homo sapiens
aggtgtctgtgctggtgatgtgtc

SEQ ID NO: 18542 - DNA, 24 bp, Homo sapiens
gagcatccgtcagaagtccagcat

SEQ ID NO: 18543 - DNA, 23 bp, Homo sapiens
ttcgtgacttcctgctcaagcca

SEQ ID NO: 18544 - DNA, 23 bp, Homo sapiens
cgtccagtctgccgcaagttcat

SEQ ID NO: 18545 - DNA, 25 bp, Homo sapiens
gatgatgagacgaagttgacgctgc

SEQ ID NO: 18546 - DNA, 25 bp, Homo sapiens
aactgaaggacaacgagaagaaccg

SEQ ID NO: 18547 - DNA, 25 bp, Homo sapiens
gatgatgagacgaagttgacgctgc

SEQ ID NO: 18548 - DNA, 25 bp, Homo sapiens
aactgaaggacaacgagaagaaccg

SEQ ID NO: 18549 - DNA, 24 bp, Homo sapiens
aacttcccagccattgccatccac

SEQ ID NO: 18550 - DNA, 25 bp, Homo sapiens
gatgatgagacgaagttgacgctgc

SEQ ID NO: 18551 - DNA, 23 bp, Homo sapiens
cgtgaaactgaaggacaacgaga

SEQ ID NO: 18552 - DNA, 23 bp, Homo sapiens
ggaagctctttgaccttctggat

SEQ ID NO: 18553 - DNA, 24 bp, Homo sapiens
aacttcccagccattgccatccac

SEQ ID NO: 18554 - DNA, 24 bp, Homo sapiens
gcattgccttggcccagctactag

SEQ ID NO: 18555 - DNA, 24 bp, Homo sapiens
tggacatcgagcgggtgaacattg

SEQ ID NO: 18556 - DNA, 25 bp, Homo sapiens
tcaacgacgaattcttgtggctacc

SEQ ID NO: 18557 - DNA, 23 bp, Homo sapiens
attatgacatgcctgaggattct

SEQ ID NO: 18558 - DNA, 24 bp, Homo sapiens
aacttcccagccattgccatccac

SEQ ID NO: 18559 - DNA, 24 bp, Homo sapiens
accttctggatgtccttgagttca

SEQ ID NO: 18560 - DNA, 25 bp, Homo sapiens
aactgaaggacaacgagaagaaccg

SEQ ID NO: 18561 - DNA, 24 bp, Homo sapiens
gtcacatggagccccttcgacaag

SEQ ID NO: 18562 - DNA, 24 bp, Homo sapiens
agtcacatggagccccttcgacaa

SEQ ID NO: 18563 - DNA, 24 bp, Homo sapiens
aagtcacatggagccccttcgaca

SEQ ID NO: 18564 - DNA, 24 bp, Homo sapiens
aggctttctataacatgctgcgac

SEQ ID NO: 18565 - DNA, 24 bp, Homo sapiens
caggctttctataacatgctgcga

SEQ ID NO: 18566 - DNA, 24 bp, Homo sapiens
acaggctttctataacatgctgcg

SEQ ID NO: 18567 - DNA, 24 bp, Homo sapiens
cggggcctgacggcctacttggaa

SEQ ID NO: 18568 - DNA, 24 bp, Homo sapiens
gcggggcctgacggcctacttgga

SEQ ID NO: 18569 - DNA, 24 bp, Homo sapiens
agcggggcctgacggcctacttgg

SEQ ID NO: 18570 - DNA, 24 bp, Homo sapiens
cggggcctgacgtgagcagctcct

SEQ ID NO: 18571 - DNA, 24 bp, Homo sapiens
gcggggcctgacgtgagcagctcc

SEQ ID NO: 18572 - DNA, 24 bp, Homo sapiens
agcggggcctgacgtgagcagctc

SEQ ID NO: 18573 - DNA, 23 bp, Homo sapiens
gctctcccgagtgtccaggatgt

SEQ ID NO: 18574 - DNA, 23 bp, Homo sapiens
ccgagcggctggacctggtgtac

SEQ ID NO: 18575 - DNA, 23 bp, Homo sapiens
tggctcacccagccgccaaggtg

SEQ ID NO: 18576 - DNA, 23 bp, Homo sapiens
tatagccagagcccaccggacac

SEQ ID NO: 18577 - DNA, 23 bp, Homo sapiens
aggcctccacagtcaccaagcgc

SEQ ID NO: 18578 - DNA, 23 bp, Homo sapiens
ccagccctcagctgcttcttctg

SEQ ID NO: 18579 - DNA, 24 bp, Homo sapiens
cccgccgcgaggtgagtccggccc

SEQ ID NO: 18580 - DNA, 24 bp, Homo sapiens
ccccgccgcgaggtgagtccggcc

SEQ ID NO: 18581 - DNA, 24 bp, Homo sapiens
gccccgccgcgaggtgagtccggc

SEQ ID NO: 18582 - DNA, 23 bp, Homo sapiens
ccgtctggagccgagatggagcc

SEQ ID NO: 18583 - DNA, 23 bp, Homo sapiens
ggattcaaccagatgcgtgagcg

SEQ ID NO: 18584 - DNA, 23 bp, Homo sapiens
cctcaccttggacacctcgcttg

SEQ ID NO: 18585 - DNA, 23 bp, Homo sapiens
ggattcaaccagatgcgtgagcg

SEQ ID NO: 18586 - DNA, 23 bp, Homo sapiens
cctcaccttggacacctcgcttg

SEQ ID NO: 18587 - DNA, 23 bp, Homo sapiens
cctctgctggaccctgactctgg

SEQ ID NO: 18588 - DNA, 24 bp, Homo sapiens
cccgccgcgagacctagtcaccga

SEQ ID NO: 18589 - DNA, 24 bp, Homo sapiens
ccccgccgcgagacctagtcaccg

SEQ ID NO: 18590 - DNA, 24 bp, Homo sapiens
gccccgccgcgagacctagtcacc

SEQ ID NO: 18591 - DNA, 24 bp, Homo sapiens
ggtagatagtgctggaaggcgtgc

SEQ ID NO: 18592 - DNA, 23 bp, Homo sapiens
gcaagcaagcaccgcaggagacg

SEQ ID NO: 18593 - DNA, 25 bp, Homo sapiens
caccgcaaagactccacagcaaatc

SEQ ID NO: 18594 - DNA, 23 bp, Homo sapiens
ggattcaaccagatgcgtgagcg

SEQ ID NO: 18595 - DNA, 23 bp, Homo sapiens
gatgggcacctgggagcaccttg

SEQ ID NO: 18596 - DNA, 23 bp, Homo sapiens
ccgtctggagccgagatggagcc

SEQ ID NO: 18597 - DNA, 24 bp, Homo sapiens
gctgagcccaggctgtggagttcc

SEQ ID NO: 18598 - DNA, 24 bp, Homo sapiens
cgctgagcccaggctgtggagttc

SEQ ID NO: 18599 - DNA, 24 bp, Homo sapiens
gcgctgagcccaggctgtggagtt

SEQ ID NO: 18600 - DNA, 24 bp, Homo sapiens
tgccccgcaaggtgcagaaggtca

SEQ ID NO: 18601 - DNA, 24 bp, Homo sapiens
gtgccccgcaaggtgcagaaggtc

SEQ ID NO: 18602 - DNA, 24 bp, Homo sapiens
tgtgccccgcaaggtgcagaaggt

SEQ ID NO: 18603 - DNA, 24 bp, Homo sapiens
acagtatccagtttcagctcaggc

SEQ ID NO: 18604 - DNA, 24 bp, Homo sapiens
gacagtatccagtttcagctcagg

SEQ ID NO: 18605 - DNA, 24 bp, Homo sapiens
cgacagtatccagtttcagctcag

SEQ ID NO: 18606 - DNA, 24 bp, Homo sapiens
gtggacaacagggccatcccagta

SEQ ID NO: 18607 - DNA, 24 bp, Homo sapiens
agtggacaacagggccatcccagt

SEQ ID NO: 18608 - DNA, 24 bp, Homo sapiens
cagtggacaacagggccatcccag

SEQ ID NO: 18609 - DNA, 25 bp, Homo sapiens
gccaaacccaagtctgaaatccacg

SEQ ID NO: 18610 - DNA, 23 bp, Homo sapiens
atcagcctaccattgccgtccct

SEQ ID NO: 18611 - DNA, 25 bp, Homo sapiens
caccgaccattccaactatgattgc

SEQ ID NO: 18612 - DNA, 23 bp, Homo sapiens
atcagcctaccattgccgtccct

SEQ ID NO: 18613 - DNA, 25 bp, Homo sapiens
caccgaccattccaactatgattgc

SEQ ID NO: 18614 - DNA, 23 bp, Homo sapiens
gcagtctttcctccgtcttgggc

SEQ ID NO: 18615 - DNA, 23 bp, Homo sapiens
atggagagtagcatccctcaagc

SEQ ID NO: 18616 - DNA, 24 bp, Homo sapiens
gtggcaacaatcagtggacaacag

SEQ ID NO: 18617 - DNA, 23 bp, Homo sapiens
ctcagccagcagtacagcacatc

SEQ ID NO: 18618 - DNA, 24 bp, Homo sapiens
gctgctgctgtgatgtccagttct

SEQ ID NO: 18619 - DNA, 25 bp, Homo sapiens
gtggcaacaatcagtggacaacagg

SEQ ID NO: 18620 - DNA, 25 bp, Homo sapiens
cacagtagcacctattttggcaacc

SEQ ID NO: 18621 - DNA, 25 bp, Homo sapiens
aacaccattccttcagcgaccacag

SEQ ID NO: 18622 - DNA, 24 bp, Homo sapiens
gcagcaatcagtattcagcgtcct

SEQ ID NO: 18623 - DNA, 25 bp, Homo sapiens
gccaaccttgtctatccagcatcct

SEQ ID NO: 18624 - DNA, 23 bp, Homo sapiens
cactggcggcacatacctacacc

SEQ ID NO: 18625 - DNA, 24 bp, Homo sapiens
accagttccgtgtccactatccga

SEQ ID NO: 18626 - DNA, 25 bp, Homo sapiens
tagcgtctaccgtccacctaaaccc

SEQ ID NO: 18627 - DNA, 25 bp, Homo sapiens
tagcgtctaccgtccacctaaaccc

SEQ ID NO: 18628 - DNA, 23 bp, Homo sapiens
gcaccacttggcacacagggaat

SEQ ID NO: 18629 - DNA, 24 bp, Homo sapiens
ttcagcagtggtgttggcagatgg

SEQ ID NO: 18630 - DNA, 25 bp, Homo sapiens
caccgaccattccaactatgattgc

SEQ ID NO: 18631 - DNA, 24 bp, Homo sapiens
cactccacccatcaccaccattgc

SEQ ID NO: 18632 - DNA, 23 bp, Homo sapiens
atcagcctaccattgccgtccct

SEQ ID NO: 18633 - DNA, 25 bp, Homo sapiens
tgcctacaagtgacctaccacctgg

SEQ ID NO: 18634 - DNA, 25 bp, Homo sapiens
actgatgatgagaagtccactgcca

SEQ ID NO: 18635 - DNA, 25 bp, Homo sapiens
tgtgagatatgtcccagtgcgtcca

SEQ ID NO: 18636 - DNA, 24 bp, Homo sapiens
ctctcctccagcatccccaaggag

SEQ ID NO: 18637 - DNA, 24 bp, Homo sapiens
actctcctccagcatccccaagga

SEQ ID NO: 18638 - DNA, 24 bp, Homo sapiens
gactctcctccagcatccccaagg

SEQ ID NO: 18639 - DNA, 25 bp, Homo sapiens
aagaagaagcgataccaggagcagc

SEQ ID NO: 18640 - DNA, 25 bp, Homo sapiens
tgaggcagtaccagaagaggatcgc

SEQ ID NO: 18641 - DNA, 23 bp, Homo sapiens
gcgggacggcaggaaggaacggg

SEQ ID NO: 18642 - DNA, 24 bp, Homo sapiens
cgtcgtgatccagaagtccagagc

SEQ ID NO: 18643 - DNA, 25 bp, Homo sapiens
ggatgtgttcaaggcaagagcgaat

SEQ ID NO: 18644 - DNA, 24 bp, Homo sapiens
gggtggaaatagcggctgcttctt

SEQ ID NO: 18645 - DNA, 24 bp, Homo sapiens
tggccccggaggtgcaaagtaaga

SEQ ID NO: 18646 - DNA, 24 bp, Homo sapiens
ctggccccggaggtgcaaagtaag

SEQ ID NO: 18647 - DNA, 24 bp, Homo sapiens
cctggccccggaggtgcaaagtaa

SEQ ID NO: 18648 - DNA, 24 bp, Homo sapiens
cctctcaccagtggtcttctgtgt

SEQ ID NO: 18649 - DNA, 24 bp, Homo sapiens
acctctcaccagtggtcttctgtg

SEQ ID NO: 18650 - DNA, 24 bp, Homo sapiens
cacctctcaccagtggtcttctgt

SEQ ID NO: 18651 - DNA, 24 bp, Homo sapiens
actgggcaaaggtaggcttgaggt

SEQ ID NO: 18652 - DNA, 24 bp, Homo sapiens
tactgggcaaaggtaggcttgagg

SEQ ID NO: 18653 - DNA, 24 bp, Homo sapiens
gtactgggcaaaggtaggcttgag

SEQ ID NO: 18654 - DNA, 25 bp, Homo sapiens
ggacgacgaagaagaggaggaggaa

SEQ ID NO: 18655 - DNA, 25 bp, Homo sapiens
ggctcaccattaaccaaagggaaga

SEQ ID NO: 18656 - DNA, 24 bp, Homo sapiens
tggcatggctaatgaagatgagtt

SEQ ID NO: 18657 - DNA, 25 bp, Homo sapiens
gctaaagagtgtgagggacttgcca

SEQ ID NO: 18658 - DNA, 25 bp, Homo sapiens
agagagcactttggatttagaaggc

SEQ ID NO: 18659 - DNA, 24 bp, Homo sapiens
gtggagagcatgttgtctgtggca

SEQ ID NO: 18660 - DNA, 25 bp, Homo sapiens
ttctccagcagaggaatccaccagt

SEQ ID NO: 18661 - DNA, 25 bp, Homo sapiens
tccgccattgatcccagagtgaagt

SEQ ID NO: 18662 - DNA, 25 bp, Homo sapiens
gcatctagaggcagcttatcatcgt

SEQ ID NO: 18663 - DNA, 25 bp, Homo sapiens
ttctccagcagaggaatccaccagt

SEQ ID NO: 18664 - DNA, 25 bp, Homo sapiens
gcatctagaggcagcttatcatcgt

SEQ ID NO: 18665 - DNA, 24 bp, Homo sapiens
aaagaagaggcaccaagagaaacg

SEQ ID NO: 18666 - DNA, 25 bp, Homo sapiens
tctgggaacatactgacagtgctgc

SEQ ID NO: 18667 - DNA, 23 bp, Homo sapiens
cctgaagaaggaggtctgccacc

SEQ ID NO: 18668 - DNA, 24 bp, Homo sapiens
aaggagaagcaagaggaagagttg

SEQ ID NO: 18669 - DNA, 25 bp, Homo sapiens
cccaccaacaccctcccagataaat

SEQ ID NO: 18670 - DNA, 25 bp, Homo sapiens
tgagaacttggaacagaggctggaa

SEQ ID NO: 18671 - DNA, 24 bp, Homo sapiens
aaagaagaggcaccaagagaaacg

SEQ ID NO: 18672 - DNA, 23 bp, Homo sapiens
cctgaagaaggaggtctgccacc

SEQ ID NO: 18673 - DNA, 25 bp, Homo sapiens
agtggtcttctgtgtaaagtgagcg

SEQ ID NO: 18674 - DNA, 25 bp, Homo sapiens
ggacgacgaagaagaggaggaggaa

SEQ ID NO: 18675 - DNA, 24 bp, Homo sapiens
ggcaagcatctgttgactgttgat

SEQ ID NO: 18676 - DNA, 24 bp, Homo sapiens
gtggagagcatgttgtctgtggca

SEQ ID NO: 18677 - DNA, 23 bp, Homo sapiens
taagacggcggcgagatcaggaa

SEQ ID NO: 18678 - DNA, 25 bp, Homo sapiens
acaacaagtacacagaaagggaggt

SEQ ID NO: 18679 - DNA, 23 bp, Homo sapiens
gcacacctcagaaagccaagcca

SEQ ID NO: 18680 - DNA, 23 bp, Homo sapiens
gcacacctcagaaagccaagcca

SEQ ID NO: 18681 - DNA, 25 bp, Homo sapiens
tgccctgaaccaaagataccctgag

SEQ ID NO: 18682 - DNA, 25 bp, Homo sapiens
tggaagagacaggatgacaaagact

SEQ ID NO: 18683 - DNA, 24 bp, Homo sapiens
agcgattctcctacctcagcctcc

SEQ ID NO: 18684 - DNA, 23 bp, Homo sapiens
cacccacctcagcctcccaaact

SEQ ID NO: 18685 - DNA, 23 bp, Homo sapiens
gtgatccacctgcctcagcctcc

SEQ ID NO: 18686 - DNA, 24 bp, Homo sapiens
gggtgacagagcgagactccattt

SEQ ID NO: 18687 - DNA, 24 bp, Homo sapiens
tgggtgacagagcgagactccatt

SEQ ID NO: 18688 - DNA, 24 bp, Homo sapiens
ctgggtgacagagcgagactccat

SEQ ID NO: 18689 - DNA, 24 bp, Homo sapiens
gatttgtccagtccaaactgggtt

SEQ ID NO: 18690 - DNA, 24 bp, Homo sapiens
cgatttgtccagtccaaactgggt

SEQ ID NO: 18691 - DNA, 24 bp, Homo sapiens
ccgatttgtccagtccaaactggg

SEQ ID NO: 18692 - DNA, 25 bp, Homo sapiens
tgctccagtgtggttattctgttgt

SEQ ID NO: 18693 - DNA, 25 bp, Homo sapiens
gaagcagccaagaagtctgacatca

SEQ ID NO: 18694 - DNA, 25 bp, Homo sapiens
ttggtagacatcagcaacaacctca

SEQ ID NO: 18695 - DNA, 24 bp, Homo sapiens
tggatcatcagattgtgcttcaag

SEQ ID NO: 18696 - DNA, 24 bp, Homo sapiens
ctggatcatcagattgtgcttcaa

SEQ ID NO: 18697 - DNA, 24 bp, Homo sapiens
tctggatcatcagattgtgcttca

SEQ ID NO: 18698 - DNA, 24 bp, Homo sapiens
gtgcttaacctgaccgaactggct

SEQ ID NO: 18699 - DNA, 25 bp, Homo sapiens
cctggtggctgatgtggttgtattc

SEQ ID NO: 18700 - DNA, 25 bp, Homo sapiens
catcatcagacccaagtgccaagtt

SEQ ID NO: 18701 - DNA, 25 bp, Homo sapiens
tgaagaactttccagagtgtgccca

SEQ ID NO: 18702 - DNA, 23 bp, Homo sapiens
agagccatctgccacaaacctgt

SEQ ID NO: 18703 - DNA, 23 bp, Homo sapiens
atctccaatccctgccaccaccc

SEQ ID NO: 18704 - DNA, 25 bp, Homo sapiens
ggctggtcttgatctcctgaactca

SEQ ID NO: 18705 - DNA, 23 bp, Homo sapiens
tctgcctcaacctcccgagtagc

SEQ ID NO: 18706 - DNA, 24 bp, Homo sapiens
aatgggattgctgggtcaaatggt

SEQ ID NO: 18707 - DNA, 24 bp, Homo sapiens
tttcaatatcggcttgtggaatat

SEQ ID NO: 18708 - DNA, 24 bp, Homo sapiens
ctttcaatatcggcttgtggaata

SEQ ID NO: 18709 - DNA, 24 bp, Homo sapiens
tctttcaatatcggcttgtggaat

SEQ ID NO: 18710 - DNA, 25 bp, Homo sapiens
atggacaggtacttcgtgtaattcc

SEQ ID NO: 18711 - DNA, 24 bp, Homo sapiens
cagacaggaatggcacaagtgatt

SEQ ID NO: 18712 - DNA, 25 bp, Homo sapiens
acttgtggatgtgaatagtcctcgg

SEQ ID NO: 18713 - DNA, 25 bp, Homo sapiens
acaaatgatgatcgttgccagccca

SEQ ID NO: 18714 - DNA, 24 bp, Homo sapiens
cagacaggaatggcacaagtgatt

SEQ ID NO: 18715 - DNA, 25 bp, Homo sapiens
acttgtggatgtgaatagtcctcgg

SEQ ID NO: 18716 - DNA, 24 bp, Homo sapiens
accgtcccgaggcaccgccggtaa

SEQ ID NO: 18717 - DNA, 24 bp, Homo sapiens
aaccgtcccgaggcaccgccggta

SEQ ID NO: 18718 - DNA, 24 bp, Homo sapiens
caaccgtcccgaggcaccgccggt

SEQ ID NO: 18719 - DNA, 23 bp, Homo sapiens
ccagtacctcgctccccacccag

SEQ ID NO: 18720 - DNA, 23 bp, Homo sapiens
agaggcatggagaaggccgcccc

SEQ ID NO: 18721 - DNA, 23 bp, Homo sapiens
gctgatcccctcgccgcgcccgc

SEQ ID NO: 18722 - DNA, 25 bp, Homo sapiens
agttgagtggagatgcttctgtgga

SEQ ID NO: 18723 - DNA, 24 bp, Homo sapiens
ctcccctgaagtgctgccgggcca

SEQ ID NO: 18724 - DNA, 24 bp, Homo sapiens
cctcccctgaagtgctgccgggcc

SEQ ID NO: 18725 - DNA, 24 bp, Homo sapiens
tcctcccctgaagtgctgccgggc

SEQ ID NO: 18726 - DNA, 24 bp, Homo sapiens
agtctgacctgagttcggaatcca

SEQ ID NO: 18727 - DNA, 24 bp, Homo sapiens
gagtctgacctgagttcggaatcc

SEQ ID NO: 18728 - DNA, 24 bp, Homo sapiens
cgagtctgacctgagttcggaatc

SEQ ID NO: 18729 - DNA, 24 bp, Homo sapiens
ccgatgccgagagacacctatggc

SEQ ID NO: 18730 - DNA, 24 bp, Homo sapiens
gccgatgccgagagacacctatgg

SEQ ID NO: 18731 - DNA, 24 bp, Homo sapiens
cgccgatgccgagagacacctatg

SEQ ID NO: 18732 - DNA, 24 bp, Homo sapiens
cagcaaacttgtctcttcaggaca

SEQ ID NO: 18733 - DNA, 24 bp, Homo sapiens
acagcaaacttgtctcttcaggac

SEQ ID NO: 18734 - DNA, 24 bp, Homo sapiens
tacagcaaacttgtctcttcagga

SEQ ID NO: 18735 - DNA, 24 bp, Homo sapiens
tgtaccctcatctgctcgtgtgga

SEQ ID NO: 18736 - DNA, 24 bp, Homo sapiens
ttgtaccctcatctgctcgtgtgg

SEQ ID NO: 18737 - DNA, 24 bp, Homo sapiens
cttgtaccctcatctgctcgtgtg

SEQ ID NO: 18738 - DNA, 25 bp, Homo sapiens
gtgctgccctacttcaatcgtcctc

SEQ ID NO: 18739 - DNA, 23 bp, Homo sapiens
catctgctcgtgtggataagccc

SEQ ID NO: 18740 - DNA, 25 bp, Homo sapiens
tcccgagattctagtgattctgctg

SEQ ID NO: 18741 - DNA, 25 bp, Homo sapiens
ttctagtgattctgctgatggacgg

SEQ ID NO: 18742 - DNA, 25 bp, Homo sapiens
cctacttcaatcgtcctccttcggc

SEQ ID NO: 18743 - DNA, 23 bp, Homo sapiens
ggtccctcctcctcctcctggta

SEQ ID NO: 18744 - DNA, 25 bp, Homo sapiens
ggagtctatgatgtggtggagttga

SEQ ID NO: 18745 - DNA, 24 bp, Homo sapiens
tgagtgtgtccgagtcccaagagg

SEQ ID NO: 18746 - DNA, 25 bp, Homo sapiens
ttctagtgattctgctgatggacgg

SEQ ID NO: 18747 - DNA, 25 bp, Homo sapiens
tcgcaaggagatgatgaaggagacg

SEQ ID NO: 18748 - DNA, 23 bp, Homo sapiens
ctgctcatcgccatcacccaccc

SEQ ID NO: 18749 - DNA, 24 bp, Homo sapiens
gaggtcttcggcactgaggtcttg

SEQ ID NO: 18750 - DNA, 24 bp, Homo sapiens
tcaccctgcaagtgagtaccatcc

SEQ ID NO: 18751 - DNA, 24 bp, Homo sapiens
ctcaccctgcaagtgagtaccatc

SEQ ID NO: 18752 - DNA, 24 bp, Homo sapiens
tctcaccctgcaagtgagtaccat

SEQ ID NO: 18753 - DNA, 24 bp, Homo sapiens
tccaaaaccaggtgagtgagtgac

SEQ ID NO: 18754 - DNA, 24 bp, Homo sapiens
ctccaaaaccaggtgagtgagtga

SEQ ID NO: 18755 - DNA, 24 bp, Homo sapiens
tctccaaaaccaggtgagtgagtg

SEQ ID NO: 18756 - DNA, 24 bp, Homo sapiens
tgagtatggaggatgaaaactttc

SEQ ID NO: 18757 - DNA, 24 bp, Homo sapiens
atgagtatggaggatgaaaacttt

SEQ ID NO: 18758 - DNA, 24 bp, Homo sapiens
aatgagtatggaggatgaaaactt

SEQ ID NO: 18759 - DNA, 24 bp, Homo sapiens
tctgattgcaggatgaaaactttc

SEQ ID NO: 18760 - DNA, 24 bp, Homo sapiens
atctgattgcaggatgaaaacttt

SEQ ID NO: 18761 - DNA, 24 bp, Homo sapiens
tatctgattgcaggatgaaaactt

SEQ ID NO: 18762 - DNA, 23 bp, Homo sapiens
gcctggcagaagatcatgcagtt

SEQ ID NO: 18763 - DNA, 23 bp, Homo sapiens
tgcactgctgttgtgaggatcag

SEQ ID NO: 18764 - DNA, 25 bp, Homo sapiens
acatcatggttagtcatggtactgc

SEQ ID NO: 18765 - DNA, 24 bp, Homo sapiens
tggtggctggggtgagtgggggcg

SEQ ID NO: 18766 - DNA, 24 bp, Homo sapiens
gtggtggctggggtgagtgggggc

SEQ ID NO: 18767 - DNA, 24 bp, Homo sapiens
ggtggtggctggggtgagtggggg

SEQ ID NO: 18768 - DNA, 23 bp, Homo sapiens
caccgaccagccacctcttggaa

SEQ ID NO: 18769 - DNA, 25 bp, Homo sapiens
actcctcgctgaatcctccacaaga

SEQ ID NO: 18770 - DNA, 23 bp, Homo sapiens
cacggaccttgagaccatcgcca

SEQ ID NO: 18771 - DNA, 24 bp, Homo sapiens
gcgtttccgagagggtgtccttag

SEQ ID NO: 18772 - DNA, 23 bp, Homo sapiens
aagccagcgatcctcacagcatg

SEQ ID NO: 18773 - DNA, 23 bp, Homo sapiens
tgcccaggacagccaaacaaccc

SEQ ID NO: 18774 - DNA, 23 bp, Homo sapiens
ctcgaccctcccagctcccttag

SEQ ID NO: 18775 - DNA, 23 bp, Homo sapiens
tgcccaggacagccaaacaaccc

SEQ ID NO: 18776 - DNA, 23 bp, Homo sapiens
aagccagcgatcctcacagcatg

SEQ ID NO: 18777 - DNA, 23 bp, Homo sapiens
ccagcatctcaggagcacctcag

SEQ ID NO: 18778 - DNA, 25 bp, Homo sapiens
ctaatagccctgagacaccgagacg

SEQ ID NO: 18779 - DNA, 25 bp, Homo sapiens
ttagacggaaagggaaactgaggct

SEQ ID NO: 18780 - DNA, 25 bp, Homo sapiens
gagacttactgcccttcacactgcg

SEQ ID NO: 18781 - DNA, 23 bp, Homo sapiens
cacggaccttgagaccatcgcca

SEQ ID NO: 18782 - DNA, 25 bp, Homo sapiens
actcctcgctgaatcctccacaaga

SEQ ID NO: 18783 - DNA, 24 bp, Homo sapiens
atctccatcctgctcaagacctgc

SEQ ID NO: 18784 - DNA, 23 bp, Homo sapiens
ggaagccatcaactcatgcctgc

SEQ ID NO: 18785 - DNA, 24 bp, Homo sapiens
gcagcagctcaaggagaaccagtt

SEQ ID NO: 18786 - DNA, 24 bp, Homo sapiens
ggctgatcttgaactcctgacctc

SEQ ID NO: 18787 - DNA, 23 bp, Homo sapiens
tcctctctccttggcctcctaaa

SEQ ID NO: 18788 - DNA, 25 bp, Homo sapiens
tccatcttgtaaaatattgctttgt

SEQ ID NO: 18789 - DNA, 23 bp, Homo sapiens
cgtgcctcagcctccagaatagc

SEQ ID NO: 18790 - DNA, 25 bp, Homo sapiens
tgaactgctgacctcaagtgatacc

SEQ ID NO: 18791 - DNA, 24 bp, Homo sapiens
gcctctcaaagtgctgggattaca

SEQ ID NO: 18792 - DNA, 24 bp, Homo sapiens
agcagccaggtctccatgtgtgcg

SEQ ID NO: 18793 - DNA, 24 bp, Homo sapiens
cagcagccaggtctccatgtgtgc

SEQ ID NO: 18794 - DNA, 24 bp, Homo sapiens
tcagcagccaggtctccatgtgtg

SEQ ID NO: 18795 - DNA, 24 bp, Homo sapiens
agtggtgcgatctcagcttactgc

SEQ ID NO: 18796 - DNA, 24 bp, Homo sapiens
caagcaattcttctgcctcagcta

SEQ ID NO: 18797 - DNA, 24 bp, Homo sapiens
agtctctctccatcgcccaggctg

SEQ ID NO: 18798 - DNA, 23 bp, Homo sapiens
cacctctctgccctccctggaca

SEQ ID NO: 18799 - DNA, 23 bp, Homo sapiens
cttcgggagatgccaccaggacc

SEQ ID NO: 18800 - DNA, 23 bp, Homo sapiens
ccagagcctgccgctactgctag

SEQ ID NO: 18801 - DNA, 24 bp, Homo sapiens
tgatggcagtcaaagcactgatga

SEQ ID NO: 18802 - DNA, 24 bp, Homo sapiens
ttgatggcagtcaaagcactgatg

SEQ ID NO: 18803 - DNA, 24 bp, Homo sapiens
attgatggcagtcaaagcactgat

SEQ ID NO: 18804 - DNA, 23 bp, Homo sapiens
aacctacacctacgactggcagc

SEQ ID NO: 18805 - DNA, 25 bp, Homo sapiens
aaggaactggtggtatctgctggag

SEQ ID NO: 18806 - DNA, 24 bp, Homo sapiens
tccagagcacctcagcaccatacc

SEQ ID NO: 18807 - DNA, 25 bp, Homo sapiens
agtggctccctcctacagttatgct

SEQ ID NO: 18808 - DNA, 24 bp, Homo sapiens
ctactacgcccagcactcaacaag

SEQ ID NO: 18809 - DNA, 23 bp, Homo sapiens
ccctaaccacagacctgactgca

SEQ ID NO: 18810 - DNA, 23 bp, Homo sapiens
gcaattctcctgcctcagcctcc

SEQ ID NO: 18811 - DNA, 23 bp, Homo sapiens
aggctggagtgcagtggcatgat

SEQ ID NO: 18812 - DNA, 23 bp, Homo sapiens
tcactgcagtctccacctcccag

SEQ ID NO: 18813 - DNA, 24 bp, Homo sapiens
gcttcagcctgcccaacatactaa

SEQ ID NO: 18814 - DNA, 24 bp, Homo sapiens
tgcttcagcctgcccaacatacta

SEQ ID NO: 18815 - DNA, 24 bp, Homo sapiens
ctgcttcagcctgcccaacatact

SEQ ID NO: 18816 - DNA, 23 bp, Homo sapiens
cccccatcctgcggcagttccct

SEQ ID NO: 18817 - DNA, 23 bp, Homo sapiens
gaagcggcctgccctgcctccct

SEQ ID NO: 18818 - DNA, 23 bp, Homo sapiens
agttgtcactcacctcacacgcc

SEQ ID NO: 18819 - DNA, 25 bp, Homo sapiens
tttcccactgctgccagatgtatgc

SEQ ID NO: 18820 - DNA, 25 bp, Homo sapiens
cgtgatcttcgtaattccagagcgg

SEQ ID NO: 18821 - DNA, 24 bp, Homo sapiens
cgcaatctcggctcaccacaacat

SEQ ID NO: 18822 - DNA, 24 bp, Homo sapiens
tgttaggctggtcttgaacttccg

SEQ ID NO: 18823 - DNA, 24 bp, Homo sapiens
gctcactgcaactgctgtctcccg

SEQ ID NO: 18824 - DNA, 23 bp, Homo sapiens
caatccacctgcctcaacctccc

SEQ ID NO: 18825 - DNA, 24 bp, Homo sapiens
ctagcaatcagcgagattccgtgg

SEQ ID NO: 18826 - DNA, 24 bp, Homo sapiens
gccgccttgcagtttgatctcaga

SEQ ID NO: 18827 - DNA, 23 bp, Homo sapiens
ctaagcaagcctgggcaatggcg

SEQ ID NO: 18828 - DNA, 24 bp, Homo sapiens
caagctgccctgcctctcaccacc

SEQ ID NO: 18829 - DNA, 24 bp, Homo sapiens
gcaagctgccctgcctctcaccac

SEQ ID NO: 18830 - DNA, 24 bp, Homo sapiens
tgcaagctgccctgcctctcacca

SEQ ID NO: 18831 - DNA, 24 bp, Homo sapiens
ccctttcagcaaattgcgatggaa

SEQ ID NO: 18832 - DNA, 24 bp, Homo sapiens
tccctttcagcaaattgcgatgga

SEQ ID NO: 18833 - DNA, 24 bp, Homo sapiens
ttccctttcagcaaattgcgatgg

SEQ ID NO: 18834 - DNA, 24 bp, Homo sapiens
gttgagctcagcgtgctcttctgc

SEQ ID NO: 18835 - DNA, 24 bp, Homo sapiens
tgttgagctcagcgtgctcttctg

SEQ ID NO: 18836 - DNA, 24 bp, Homo sapiens
ctgttgagctcagcgtgctcttct

SEQ ID NO: 18837 - DNA, 24 bp, Homo sapiens
tagcattacagatgcccctgctaa

SEQ ID NO: 18838 - DNA, 24 bp, Homo sapiens
atagcattacagatgcccctgcta

SEQ ID NO: 18839 - DNA, 24 bp, Homo sapiens
aatagcattacagatgcccctgct

SEQ ID NO: 18840 - DNA, 24 bp, Homo sapiens
ttataacactgccacccaacttga

SEQ ID NO: 18841 - DNA, 24 bp, Homo sapiens
gttataacactgccacccaacttg

SEQ ID NO: 18842 - DNA, 24 bp, Homo sapiens
ggttataacactgccacccaactt

SEQ ID NO: 18843 - DNA, 24 bp, Homo sapiens
actccactgagctcgctcccccac

SEQ ID NO: 18844 - DNA, 24 bp, Homo sapiens
aactccactgagctcgctccccca

SEQ ID NO: 18845 - DNA, 24 bp, Homo sapiens
gaactccactgagctcgctccccc

SEQ ID NO: 18846 - DNA, 24 bp, Homo sapiens
cagtgtttacagaccttagcagca

SEQ ID NO: 18847 - DNA, 24 bp, Homo sapiens
gcagtgtttacagaccttagcagc

SEQ ID NO: 18848 - DNA, 24 bp, Homo sapiens
agcagtgtttacagaccttagcag

SEQ ID NO: 18849 - DNA, 25 bp, Homo sapiens
gccagtccatcttcagtaccatcca

SEQ ID NO: 18850 - DNA, 25 bp, Homo sapiens
atccaagaagagaagtcaatcctgc

SEQ ID NO: 18851 - DNA, 24 bp, Homo sapiens
tagaccctgacgaaaccagcacca

SEQ ID NO: 18852 - DNA, 25 bp, Homo sapiens
actgccaggagatgttcggaatgac

SEQ ID NO: 18853 - DNA, 25 bp, Homo sapiens
ccacggtgagtttgacaaagggaag

SEQ ID NO: 18854 - DNA, 25 bp, Homo sapiens
aagaatgtggaggtgacgatgtctg

SEQ ID NO: 18855 - DNA, 24 bp, Homo sapiens
agtctattaccaagtcaagcagcc

SEQ ID NO: 18856 - DNA, 25 bp, Homo sapiens
tcttggagaaagcaattcaccctgg

SEQ ID NO: 18857 - DNA, 25 bp, Homo sapiens
aatgtggaggtgacgatgtctgtgc

SEQ ID NO: 18858 - DNA, 25 bp, Homo sapiens
cctatgacttccttgtgtttgacgc

SEQ ID NO: 18859 - DNA, 25 bp, Homo sapiens
agttaatggaagtggatggaggaga

SEQ ID NO: 18860 - DNA, 25 bp, Homo sapiens
cagaatgttgacctgttaggcttgt

SEQ ID NO: 18861 - DNA, 25 bp, Homo sapiens
ggcagaggagacgaacaatacaagg

SEQ ID NO: 18862 - DNA, 24 bp, Homo sapiens
cctcctggtcagcagcctcttaga

SEQ ID NO: 18863 - DNA, 25 bp, Homo sapiens
gcaagatgagagcaaggagaaccgt

SEQ ID NO: 18864 - DNA, 24 bp, Homo sapiens
aagaggcaactgtggaagacctgg

SEQ ID NO: 18865 - DNA, 23 bp, Homo sapiens
tgaaaccgtgattcctggcgagc

SEQ ID NO: 18866 - DNA, 25 bp, Homo sapiens
agaatgggctgtcatctggcgaaag

SEQ ID NO: 18867 - DNA, 24 bp, Homo sapiens
aagaggcaactgtggaagacctgg

SEQ ID NO: 18868 - DNA, 23 bp, Homo sapiens
tgaaaccgtgattcctggcgagc

SEQ ID NO: 18869 - DNA, 23 bp, Homo sapiens
ctggtggtgcgagatgacaatgg

SEQ ID NO: 18870 - DNA, 23 bp, Homo sapiens
ctggtggtgcgagatgacaatgg

SEQ ID NO: 18871 - DNA, 24 bp, Homo sapiens
tagaccctgacgaaaccagcacca

SEQ ID NO: 18872 - DNA, 25 bp, Homo sapiens
atccaagaagagaagtcaatcctgc

SEQ ID NO: 18873 - DNA, 25 bp, Homo sapiens
gtggtgcgagatgacaatgggaaca

SEQ ID NO: 18874 - DNA, 25 bp, Homo sapiens
gccagtccatcttcagtaccatcca

SEQ ID NO: 18875 - DNA, 25 bp, Homo sapiens
acagaccttagcagcatggacctca

SEQ ID NO: 18876 - DNA, 25 bp, Homo sapiens
gtggtgcgagatgacaatgggaaca

SEQ ID NO: 18877 - DNA, 24 bp, Homo sapiens
accctgacgaaaccagcaccattg

SEQ ID NO: 18878 - DNA, 23 bp, Homo sapiens
aggtggcctccaaaaggattgag

SEQ ID NO: 18879 - DNA, 23 bp, Homo sapiens
ctggtggtgcgagatgacaatgg

SEQ ID NO: 18880 - DNA, 25 bp, Homo sapiens
agaatgggctgtcatctggcgaaag

SEQ ID NO: 18881 - DNA, 23 bp, Homo sapiens
tgaaaccgtgattcctggcgagc

SEQ ID NO: 18882 - DNA, 25 bp, Homo sapiens
ctctacgacccagaccagtccactt

SEQ ID NO: 18883 - DNA, 25 bp, Homo sapiens
gccagtccatcttcagtaccatcca

SEQ ID NO: 18884 - DNA, 25 bp, Homo sapiens
atccaagaagagaagtcaatcctgc

SEQ ID NO: 18885 - DNA, 23 bp, Homo sapiens
ccagaggcagctcatcatgtcgc

SEQ ID NO: 18886 - DNA, 25 bp, Homo sapiens
actgccaggagatgttcggaatgac

SEQ ID NO: 18887 - DNA, 25 bp, Homo sapiens
ccacggtgagtttgacaaagggaag

SEQ ID NO: 18888 - DNA, 25 bp, Homo sapiens
acatgggaaggtggatgatgaagaa

SEQ ID NO: 18889 - DNA, 23 bp, Homo sapiens
ccagaggcagctcatcatgtcgc

SEQ ID NO: 18890 - DNA, 24 bp, Homo sapiens
ggagaatgagccactcacttcagt

SEQ ID NO: 18891 - DNA, 23 bp, Homo sapiens
taaagtgattgcagcaaaggaag

SEQ ID NO: 18892 - DNA, 24 bp, Homo sapiens
caacagcaatagcccggaagatgg

SEQ ID NO: 18893 - DNA, 23 bp, Homo sapiens
agctcttgcccggtgacctcacc

SEQ ID NO: 18894 - DNA, 25 bp, Homo sapiens
cagaagaatttttcacacttggttg

SEQ ID NO: 18895 - DNA, 23 bp, Homo sapiens
ccagaggcagctcatcatgtcgc

SEQ ID NO: 18896 - DNA, 25 bp, Homo sapiens
tggagtggcagtgatggatattact

SEQ ID NO: 18897 - DNA, 24 bp, Homo sapiens
ctgaaggaaggcaagaagcacacc

SEQ ID NO: 18898 - DNA, 24 bp, Homo sapiens
gccttcgtgaagctgatgaacccg

SEQ ID NO: 18899 - DNA, 23 bp, Homo sapiens
ccactctgcaggatgggaggcac

SEQ ID NO: 18900 - DNA, 24 bp, Homo sapiens
gcaccgagactgtgagaactacac

SEQ ID NO: 18901 - DNA, 24 bp, Homo sapiens
gccctgtgtgcctcatttgcttca

SEQ ID NO: 18902 - DNA, 25 bp, Homo sapiens
gcaaagagttggctgagacttacga

SEQ ID NO: 18903 - DNA, 24 bp, Homo sapiens
tgccgcccagctacaaggataaac

SEQ ID NO: 18904 - DNA, 25 bp, Homo sapiens
gttcttcacctcctcagtcaacacc

SEQ ID NO: 18905 - DNA, 23 bp, Homo sapiens
tccactcactcccaaagccacca

SEQ ID NO: 18906 - DNA, 23 bp, Homo sapiens
gcagccagaggaactccactgag

SEQ ID NO: 18907 - DNA, 25 bp, Homo sapiens
tcacggttcttcacctcctcagtca

SEQ ID NO: 18908 - DNA, 23 bp, Homo sapiens
gagcccacctccactcactccca

SEQ ID NO: 18909 - DNA, 23 bp, Homo sapiens
gccaaagagtctccagttgatgg

SEQ ID NO: 18910 - DNA, 25 bp, Homo sapiens
ttagagaggagaacagcgagaaccg

SEQ ID NO: 18911 - DNA, 25 bp, Homo sapiens
ctcgtcaggtgccagagttgaagat

SEQ ID NO: 18912 - DNA, 25 bp, Homo sapiens
aactcgtctgacaatgctccttcca

SEQ ID NO: 18913 - DNA, 23 bp, Homo sapiens
cactcctgtcccacctccacctc

SEQ ID NO: 18914 - DNA, 23 bp, Homo sapiens
gcagccagaggaactccactgag

SEQ ID NO: 18915 - DNA, 23 bp, Homo sapiens
actgcctgtccgaagagaagcca

SEQ ID NO: 18916 - DNA, 23 bp, Homo sapiens
cactcctgtcccacctccacctc

SEQ ID NO: 18917 - DNA, 23 bp, Homo sapiens
aaagcaagccctatgaaggcagc

SEQ ID NO: 18918 - DNA, 24 bp, Homo sapiens
ctgctgttcaggcaagtttgtcca

SEQ ID NO: 18919 - DNA, 24 bp, Homo sapiens
gctgctgttcaggcaagtttgtcc

SEQ ID NO: 18920 - DNA, 24 bp, Homo sapiens
tgctgctgttcaggcaagtttgtc

SEQ ID NO: 18921 - DNA, 24 bp, Homo sapiens
tgtctgtacagctgattttcacac

SEQ ID NO: 18922 - DNA, 24 bp, Homo sapiens
ctgtctgtacagctgattttcaca

SEQ ID NO: 18923 - DNA, 24 bp, Homo sapiens
tctgtctgtacagctgattttcac

SEQ ID NO: 18924 - DNA, 24 bp, Homo sapiens
cagctactcaggttcagaatttaa

SEQ ID NO: 18925 - DNA, 24 bp, Homo sapiens
gcagctactcaggttcagaattta

SEQ ID NO: 18926 - DNA, 24 bp, Homo sapiens
tgcagctactcaggttcagaattt

SEQ ID NO: 18927 - DNA, 24 bp, Homo sapiens
cagctactcaggtgagcttgtcta

SEQ ID NO: 18928 - DNA, 24 bp, Homo sapiens
gcagctactcaggtgagcttgtct

SEQ ID NO: 18929 - DNA, 24 bp, Homo sapiens
tgcagctactcaggtgagcttgtc

SEQ ID NO: 18930 - DNA, 25 bp, Homo sapiens
tcctgttgtctcgtcgtcatcgtca

SEQ ID NO: 18931 - DNA, 23 bp, Homo sapiens
caagcctggaatcacgaagcaca

SEQ ID NO: 18932 - DNA, 25 bp, Homo sapiens
ttaacattacgcagccagaagttgg

SEQ ID NO: 18933 - DNA, 24 bp, Homo sapiens
gcagcccaacaacagcacttgatg

SEQ ID NO: 18934 - DNA, 25 bp, Homo sapiens
tcttcagcagcagcatttaagcagc

SEQ ID NO: 18935 - DNA, 24 bp, Homo sapiens
ttcagagccttgctgctgttcagg

SEQ ID NO: 18936 - DNA, 25 bp, Homo sapiens
tcctgttgtctcgtcgtcatcgtca

SEQ ID NO: 18937 - DNA, 23 bp, Homo sapiens
accactgtggctgctgtacagtc

SEQ ID NO: 18938 - DNA, 23 bp, Homo sapiens
cttccagttctaccagcggcagt

SEQ ID NO: 18939 - DNA, 25 bp, Homo sapiens
tcttcagcagcagcatttaagcagc

SEQ ID NO: 18940 - DNA, 24 bp, Homo sapiens
gcagcccaacaacagcacttgatg

SEQ ID NO: 18941 - DNA, 23 bp, Homo sapiens
caagcctggaatcacgaagcaca

SEQ ID NO: 18942 - DNA, 25 bp, Homo sapiens
attctccaattcagcctcattctct

SEQ ID NO: 18943 - DNA, 25 bp, Homo sapiens
agcagattcctcttcattcaccacc

SEQ ID NO: 18944 - DNA, 23 bp, Homo sapiens
caagcctggaatcacgaagcaca

SEQ ID NO: 18945 - DNA, 24 bp, Homo sapiens
atctagctcacagaatggtccacc

SEQ ID NO: 18946 - DNA, 25 bp, Homo sapiens
tcagccaacgagatccttctccaga

SEQ ID NO: 18947 - DNA, 25 bp, Homo sapiens
tcctgttgtctcgtcgtcatcgtca

SEQ ID NO: 18948 - DNA, 23 bp, Homo sapiens
cttccagttctaccagcggcagt

SEQ ID NO: 18949 - DNA, 25 bp, Homo sapiens
tcttcagcagcagcatttaagcagc

SEQ ID NO: 18950 - DNA, 25 bp, Homo sapiens
acatgcggataattcatctgacaca

SEQ ID NO: 18951 - DNA, 25 bp, Homo sapiens
gagccatttcctgtgagtcgttcct

SEQ ID NO: 18952 - DNA, 25 bp, Homo sapiens
caccacctccattgttacttccagc

SEQ ID NO: 18953 - DNA, 23 bp, Homo sapiens
gccttctccgctgaccagtctcg

SEQ ID NO: 18954 - DNA, 23 bp, Homo sapiens
aaggctccacctggttgtctcac

SEQ ID NO: 18955 - DNA, 25 bp, Homo sapiens
ttccagaggtccatcacatttccca

SEQ ID NO: 18956 - DNA, 25 bp, Homo sapiens
actggcagcctatgctcacattgtc

SEQ ID NO: 18957 - DNA, 23 bp, Homo sapiens
cagctctctctgtggggtgacaa

SEQ ID NO: 18958 - DNA, 23 bp, Homo sapiens
agtcaaggaggctgtgaggaggc

SEQ ID NO: 18959 - DNA, 23 bp, Homo sapiens
ctggagtcggtgatggaggcaac

SEQ ID NO: 18960 - DNA, 25 bp, Homo sapiens
ttgagcaaggtgttctgaagacgca

SEQ ID NO: 18961 - DNA, 23 bp, Homo sapiens
gcctcgtcttctccctggtctca

SEQ ID NO: 18962 - DNA, 25 bp, Homo sapiens
gcttctgcctgctcctcttctacct

SEQ ID NO: 18963 - DNA, 24 bp, Homo sapiens
aactgctgtgtacctcttgctgcc

SEQ ID NO: 18964 - DNA, 23 bp, Homo sapiens
atctcccgaagccacacagaagt

SEQ ID NO: 18965 - DNA, 23 bp, Homo sapiens
gcctcgtcttctccctggtctca

SEQ ID NO: 18966 - DNA, 25 bp, Homo sapiens
gcttctgcctgctcctcttctacct

SEQ ID NO: 18967 - DNA, 25 bp, Homo sapiens
cctctgcttctggtgaacattggct

SEQ ID NO: 18968 - DNA, 25 bp, Homo sapiens
ggattcaatggacggtcacagtgct

SEQ ID NO: 18969 - DNA, 25 bp, Homo sapiens
actggatgaactagattgcttgatc

SEQ ID NO: 18970 - DNA, 25 bp, Homo sapiens
tggtctctgctgtcttcttactggc

SEQ ID NO: 18971 - DNA, 24 bp, Homo sapiens
gctcttgaaatggcatctcgtgga

SEQ ID NO: 18972 - DNA, 25 bp, Homo sapiens
gggactatgagaggtttggactgcc

SEQ ID NO: 18973 - DNA, 25 bp, Homo sapiens
gcttcaaactcaaaggaaacaaccc

SEQ ID NO: 18974 - DNA, 24 bp, Homo sapiens
gttcctgagtcctttgagcacctg

SEQ ID NO: 18975 - DNA, 24 bp, Homo sapiens
ccagaaccaccagcaccactacct

SEQ ID NO: 18976 - DNA, 24 bp, Homo sapiens
aaacatctcaggtagcggaagtga

SEQ ID NO: 18977 - DNA, 24 bp, Homo sapiens
taaacatctcaggtagcggaagtg

SEQ ID NO: 18978 - DNA, 24 bp, Homo sapiens
ttaaacatctcaggtagcggaagt

SEQ ID NO: 18979 - DNA, 23 bp, Homo sapiens
ggttcaagcgattctctgcctca

SEQ ID NO: 18980 - DNA, 25 bp, Homo sapiens
aactcctgacctcaagtgatccacc

SEQ ID NO: 18981 - DNA, 23 bp, Homo sapiens
atgagccactgtgcccagcctac

SEQ ID NO: 18982 - DNA, 25 bp, Homo sapiens
gtggcgtctctctggatgaaactgg

SEQ ID NO: 18983 - DNA, 25 bp, Homo sapiens
tcgctcttgagactgctgaatgtga

SEQ ID NO: 18984 - DNA, 24 bp, Homo sapiens
gacccacacttgcctccctcacta

SEQ ID NO: 18985 - DNA, 24 bp, Homo sapiens
ttggcttgcctggctgattcatgt

SEQ ID NO: 18986 - DNA, 23 bp, Homo sapiens
ggaccaccatcacaccctcctgt

SEQ ID NO: 18987 - DNA, 25 bp, Homo sapiens
gcctcagagtatcccttatcagaac

SEQ ID NO: 18988 - DNA, 24 bp, Homo sapiens
tgccggcacaggtacaaagtgaaa

SEQ ID NO: 18989 - DNA, 24 bp, Homo sapiens
gtgccggcacaggtacaaagtgaa

SEQ ID NO: 18990 - DNA, 24 bp, Homo sapiens
agtgccggcacaggtacaaagtga

SEQ ID NO: 18991 - DNA, 23 bp, Homo sapiens
tcacaacaatctccgcctcccga

SEQ ID NO: 18992 - DNA, 23 bp, Homo sapiens
ggaggctgggcacggtggctcat

SEQ ID NO: 18993 - DNA, 23 bp, Homo sapiens
aattctcgtgcctttggccctcg

SEQ ID NO: 18994 - DNA, 24 bp, Homo sapiens
gggaggccgaggcgggtgccacgt

SEQ ID NO: 18995 - DNA, 24 bp, Homo sapiens
cgggaggccgaggcgggtgccacg

SEQ ID NO: 18996 - DNA, 24 bp, Homo sapiens
tcgggaggccgaggcgggtgccac

SEQ ID NO: 18997 - DNA, 23 bp, Homo sapiens
ctatgtgggcttcgtgctgtggg

SEQ ID NO: 18998 - DNA, 25 bp, Homo sapiens
tccattcagatttacaccaaaccct

SEQ ID NO: 18999 - DNA, 25 bp, Homo sapiens
gcccaacatagtttgtaaagcctgt

SEQ ID NO: 19000 - DNA, 24 bp, Homo sapiens
tgggggtcgaggtctccttgaaga

SEQ ID NO: 19001 - DNA, 24 bp, Homo sapiens
atgggggtcgaggtctccttgaag

SEQ ID NO: 19002 - DNA, 24 bp, Homo sapiens
aatgggggtcgaggtctccttgaa

SEQ ID NO: 19003 - DNA, 25 bp, Homo sapiens
aggctctgaagatgcttatgttgga

SEQ ID NO: 19004 - DNA, 25 bp, Homo sapiens
cacaacaccacaatgcacaccactg

SEQ ID NO: 19005 - DNA, 25 bp, Homo sapiens
agtatgtgttagtggtcaaggagca

SEQ ID NO: 19006 - DNA, 24 bp, Homo sapiens
tgtcccaccatcaagcactgtaac

SEQ ID NO: 19007 - DNA, 24 bp, Homo sapiens
gactgtgaaaatgttggactatat

SEQ ID NO: 19008 - DNA, 25 bp, Homo sapiens
tgcgttagctgggatttgggttaaa

SEQ ID NO: 19009 - DNA, 23 bp, Homo sapiens
atcatggacgtgatgttggtgtg

SEQ ID NO: 19010 - DNA, 25 bp, Homo sapiens
ggaaacccaattattagacggaatc

SEQ ID NO: 19011 - DNA, 25 bp, Homo sapiens
acctgttccttatccgatacctcca

SEQ ID NO: 19012 - DNA, 25 bp, Homo sapiens
aaccacctccttcaacatataatcc

SEQ ID NO: 19013 - DNA, 25 bp, Homo sapiens
tggtgaagaatgtactaacgaaggc

SEQ ID NO: 19014 - DNA, 24 bp, Homo sapiens
tgtcactgcaggaagtactcccac

SEQ ID NO: 19015 - DNA, 24 bp, Homo sapiens
ttgtcactgcaggaagtactccca

SEQ ID NO: 19016 - DNA, 24 bp, Homo sapiens
tttgtcactgcaggaagtactccc

SEQ ID NO: 19017 - DNA, 24 bp, Homo sapiens
agaccacagagtcgcttcatggag

SEQ ID NO: 19018 - DNA, 24 bp, Homo sapiens
gagaccacagagtcgcttcatgga

SEQ ID NO: 19019 - DNA, 24 bp, Homo sapiens
agagaccacagagtcgcttcatgg

SEQ ID NO: 19020 - DNA, 24 bp, Homo sapiens
agcattcacagttttgacagtgac

SEQ ID NO: 19021 - DNA, 24 bp, Homo sapiens
cagcattcacagttttgacagtga

SEQ ID NO: 19022 - DNA, 24 bp, Homo sapiens
gcagcattcacagttttgacagtg

SEQ ID NO: 19023 - DNA, 24 bp, Homo sapiens
agtaacctctgtgtgctggagccc

SEQ ID NO: 19024 - DNA, 24 bp, Homo sapiens
cagtaacctctgtgtgctggagcc

SEQ ID NO: 19025 - DNA, 24 bp, Homo sapiens
gcagtaacctctgtgtgctggagc

SEQ ID NO: 19026 - DNA, 24 bp, Homo sapiens
cctccttcccaccctcaacctctg

SEQ ID NO: 19027 - DNA, 24 bp, Homo sapiens
ccttcatattccagtggctccgac

SEQ ID NO: 19028 - DNA, 24 bp, Homo sapiens
gaagtcatctgctacggtcactgg

SEQ ID NO: 19029 - DNA, 24 bp, Homo sapiens
ctctgccaccttcatcacctgctg

SEQ ID NO: 19030 - DNA, 24 bp, Homo sapiens
gaagtcatctgctacggtcactgg

SEQ ID NO: 19031 - DNA, 24 bp, Homo sapiens
ccttcatattccagtggctccgac

SEQ ID NO: 19032 - DNA, 24 bp, Homo sapiens
cagcgtctcctgtggctccatcag

SEQ ID NO: 19033 - DNA, 24 bp, Homo sapiens
cattctcctttggatcatctggtt

SEQ ID NO: 19034 - DNA, 24 bp, Homo sapiens
agtgccaagtgtgtctgctccaaa

SEQ ID NO: 19035 - DNA, 24 bp, Homo sapiens
aaagcccgaacttccaaagcctgt

SEQ ID NO: 19036 - DNA, 24 bp, Homo sapiens
tgaggagatgaagatgctgcgaac

SEQ ID NO: 19037 - DNA, 24 bp, Homo sapiens
ttgagggctttgctggtgttgagg

SEQ ID NO: 19038 - DNA, 24 bp, Homo sapiens
tgaggagatgaagatgctgcgaac

SEQ ID NO: 19039 - DNA, 24 bp, Homo sapiens
aaagcccgaacttccaaagcctgt

SEQ ID NO: 19040 - DNA, 24 bp, Homo sapiens
caccatcaggacgatctgctcagg

SEQ ID NO: 19041 - DNA, 24 bp, Homo sapiens
catccgcaaacccagcccttccta

SEQ ID NO: 19042 - DNA, 24 bp, Homo sapiens
gccacctccagagctacagtcttc

SEQ ID NO: 19043 - DNA, 24 bp, Homo sapiens
ctgtcttctctcagccaggcagtg

SEQ ID NO: 19044 - DNA, 24 bp, Homo sapiens
ttaaccccaagacttgctacattt

SEQ ID NO: 19045 - DNA, 24 bp, Homo sapiens
tttaaccccaagacttgctacatt

SEQ ID NO: 19046 - DNA, 24 bp, Homo sapiens
ttttaaccccaagacttgctacat

SEQ ID NO: 19047 - DNA, 23 bp, Homo sapiens
accttgtgatccgcctgcctcca

SEQ ID NO: 19048 - DNA, 23 bp, Homo sapiens
ttgttagccaggatggtcttgat

SEQ ID NO: 19049 - DNA, 25 bp, Homo sapiens
ctctcagtcaggcaccatctcatat

SEQ ID NO: 19050 - DNA, 25 bp, Homo sapiens
ctcacttacctcagcagtcttctgg

SEQ ID NO: 19051 - DNA, 25 bp, Homo sapiens
caacgacagaggtgacagttctaca

SEQ ID NO: 19052 - DNA, 24 bp, Homo sapiens
ctgtccctttcagcgaatggctcc

SEQ ID NO: 19053 - DNA, 24 bp, Homo sapiens
cctgccagtggttatcaagctcct

SEQ ID NO: 19054 - DNA, 24 bp, Homo sapiens
aagcagaccttggagaacagtcag

SEQ ID NO: 19055 - DNA, 24 bp, Homo sapiens
tgagatggacctatcagattggct

SEQ ID NO: 19056 - DNA, 24 bp, Homo sapiens
ggcagtcgtgaaaccagtgagaag

SEQ ID NO: 19057 - DNA, 24 bp, Homo sapiens
caatctgaagtgcctgaatgacca

SEQ ID NO: 19058 - DNA, 24 bp, Homo sapiens
gtggtcagcagccagtcagtctgc

SEQ ID NO: 19059 - DNA, 24 bp, Homo sapiens
agtggtcagcagccagtcagtctg

SEQ ID NO: 19060 - DNA, 24 bp, Homo sapiens
cagtggtcagcagccagtcagtct

SEQ ID NO: 19061 - DNA, 24 bp, Homo sapiens
cgcggtggaagggtcttactggac

SEQ ID NO: 19062 - DNA, 24 bp, Homo sapiens
gcgcggtggaagggtcttactgga

SEQ ID NO: 19063 - DNA, 24 bp, Homo sapiens
ggcgcggtggaagggtcttactgg

SEQ ID NO: 19064 - DNA, 25 bp, Homo sapiens
gtttgctgcttctgctttggtgaca

SEQ ID NO: 19065 - DNA, 25 bp, Homo sapiens
aggatgatgtggtgcttggaatcgg

SEQ ID NO: 19066 - DNA, 25 bp, Homo sapiens
acatacaagtccatcaacggcaggt

SEQ ID NO: 19067 - DNA, 25 bp, Homo sapiens
gagaagcgagatggttccagcacaa

SEQ ID NO: 19068 - DNA, 23 bp, Homo sapiens
agtggtcagcagccagtcagtct

SEQ ID NO: 19069 - DNA, 25 bp, Homo sapiens
ttgaggagatgattgaccgcctaga

SEQ ID NO: 19070 - DNA, 25 bp, Homo sapiens
gcaacatcaacagcaactggcactc

SEQ ID NO: 19071 - DNA, 25 bp, Homo sapiens
gtaattcctccaccaacacatcaca

SEQ ID NO: 19072 - DNA, 25 bp, Homo sapiens
aacagcagcttgcacaaattcagca

SEQ ID NO: 19073 - DNA, 25 bp, Homo sapiens
actgcttaactactctcaccgtacc

SEQ ID NO: 19074 - DNA, 25 bp, Homo sapiens
cggtggaagggtcttactggacaga

SEQ ID NO: 19075 - DNA, 25 bp, Homo sapiens
tcctcaccacaacattctccagtca

SEQ ID NO: 19076 - DNA, 25 bp, Homo sapiens
acatacaagtccatcaacggcaggt

SEQ ID NO: 19077 - DNA, 25 bp, Homo sapiens
ctgagtcatcaagtaactgctgcca

SEQ ID NO: 19078 - DNA, 24 bp, Homo sapiens
aagtgctgttccatcatctgcctt

SEQ ID NO: 19079 - DNA, 23 bp, Homo sapiens
atctgcccacctctgcctcccaa

SEQ ID NO: 19080 - DNA, 23 bp, Homo sapiens
ccaggctggtctggaactcctga

SEQ ID NO: 19081 - DNA, 24 bp, Homo sapiens
cgactcctgagctcgccgcgcatg

SEQ ID NO: 19082 - DNA, 24 bp, Homo sapiens
tcgactcctgagctcgccgcgcat

SEQ ID NO: 19083 - DNA, 24 bp, Homo sapiens
ctcgactcctgagctcgccgcgca

SEQ ID NO: 19084 - DNA, 25 bp, Homo sapiens
atctgtctgaccacctctcctcaca

SEQ ID NO: 19085 - DNA, 23 bp, Homo sapiens
tctttccagcccagcatcctcct

SEQ ID NO: 19086 - DNA, 23 bp, Homo sapiens
gcagcagttcttcaggaggagga

SEQ ID NO: 19087 - DNA, 24 bp, Homo sapiens
ttgtgtggtcgcgtctcggaaacc

SEQ ID NO: 19088 - DNA, 24 bp, Homo sapiens
tccgagtggagagagcgagctgag

SEQ ID NO: 19089 - DNA, 24 bp, Homo sapiens
cttgcagcatggctgaccaactga

SEQ ID NO: 19090 - DNA, 24 bp, Homo sapiens
gagcgagctgagtggttgtgtggt

SEQ ID NO: 19091 - DNA, 24 bp, Homo sapiens
cttgcagcatggctgaccaactga

SEQ ID NO: 19092 - DNA, 24 bp, Homo sapiens
tgtgtggtcgcgtctcggaaaccg

SEQ ID NO: 19093 - DNA, 24 bp, Homo sapiens
agtccgagtggagagagcgagctg

SEQ ID NO: 19094 - DNA, 24 bp, Homo sapiens
ccaggatcagggtccgaggcggtg

SEQ ID NO: 19095 - DNA, 24 bp, Homo sapiens
cccaggatcagggtccgaggcggt

SEQ ID NO: 19096 - DNA, 24 bp, Homo sapiens
gcccaggatcagggtccgaggcgg

SEQ ID NO: 19097 - DNA, 24 bp, Homo sapiens
ggattgggaagggcacctgtgctg

SEQ ID NO: 19098 - DNA, 24 bp, Homo sapiens
aggattgggaagggcacctgtgct

SEQ ID NO: 19099 - DNA, 24 bp, Homo sapiens
caggattgggaagggcacctgtgc

SEQ ID NO: 19100 - DNA, 24 bp, Homo sapiens
agtatggagtgacgactttggttc

SEQ ID NO: 19101 - DNA, 25 bp, Homo sapiens
accaatgctactctcaacaagttca

SEQ ID NO: 19102 - DNA, 23 bp, Homo sapiens
ttgccataatgaaccgtccagcc

SEQ ID NO: 19103 - DNA, 23 bp, Homo sapiens
gaagagccaggttgctgtgttgc

SEQ ID NO: 19104 - DNA, 25 bp, Homo sapiens
aatgtggaatgaagtacgaagatgc

SEQ ID NO: 19105 - DNA, 23 bp, Homo sapiens
tgtgttgcaggattgggaagggc

SEQ ID NO: 19106 - DNA, 23 bp, Homo sapiens
gattacaggcacgcaccaccaca

SEQ ID NO: 19107 - DNA, 23 bp, Homo sapiens
gcgattctcatgcctcagcctcc

SEQ ID NO: 19108 - DNA, 25 bp, Homo sapiens
tctggaactcctgacctcaagtgat

SEQ ID NO: 19109 - DNA, 24 bp, Homo sapiens
agatgacttggcctccctcagtga

SEQ ID NO: 19110 - DNA, 24 bp, Homo sapiens
cagatgacttggcctccctcagtg

SEQ ID NO: 19111 - DNA, 24 bp, Homo sapiens
acagatgacttggcctccctcagt

SEQ ID NO: 19112 - DNA, 24 bp, Homo sapiens
ggatgcagatgggaacgggaccat

SEQ ID NO: 19113 - DNA, 24 bp, Homo sapiens
tggatgcagatgggaacgggacca

SEQ ID NO: 19114 - DNA, 24 bp, Homo sapiens
gtggatgcagatgggaacgggacc

SEQ ID NO: 19115 - DNA, 24 bp, Homo sapiens
tctttgacaaggatgggaatggct

SEQ ID NO: 19116 - DNA, 24 bp, Homo sapiens
gtctttgacaaggatgggaatggc

SEQ ID NO: 19117 - DNA, 24 bp, Homo sapiens
tgtctttgacaaggatgggaatgg

SEQ ID NO: 19118 - DNA, 24 bp, Homo sapiens
ggatatgatcaatgaggtggatgc

SEQ ID NO: 19119 - DNA, 24 bp, Homo sapiens
ggcactatcaccaccaaggagttg

SEQ ID NO: 19120 - DNA, 24 bp, Homo sapiens
gccagaaagatgaaggacacagac

SEQ ID NO: 19121 - DNA, 24 bp, Homo sapiens
gagatccgagaggcgttccgtgtc

SEQ ID NO: 19122 - DNA, 24 bp, Homo sapiens
gacagtgaggaggagatccgagag

SEQ ID NO: 19123 - DNA, 24 bp, Homo sapiens
agacagtgaggaggagatccgaga

SEQ ID NO: 19124 - DNA, 24 bp, Homo sapiens
cagacagtgaggaggagatccgag

SEQ ID NO: 19125 - DNA, 24 bp, Homo sapiens
gctgaccgatgaggaggtggatga

SEQ ID NO: 19126 - DNA, 24 bp, Homo sapiens
agggaggctgacatcgatggagat

SEQ ID NO: 19127 - DNA, 24 bp, Homo sapiens
cgcagagctgcgtcacgtaatgac

SEQ ID NO: 19128 - DNA, 24 bp, Homo sapiens
ccagccaagagctgagggtaaggg

SEQ ID NO: 19129 - DNA, 24 bp, Homo sapiens
cccagccaagagctgagggtaagg

SEQ ID NO: 19130 - DNA, 24 bp, Homo sapiens
acccagccaagagctgagggtaag

SEQ ID NO: 19131 - DNA, 24 bp, Homo sapiens
tctctcttcaacactcccctgcgt

SEQ ID NO: 19132 - DNA, 24 bp, Homo sapiens
gcgatgcccgttctcttgatctct

SEQ ID NO: 19133 - DNA, 24 bp, Homo sapiens
ccgatgaggaggtggatgagatga

SEQ ID NO: 19134 - DNA, 24 bp, Homo sapiens
gctgttctgtaaatacctggtgct

SEQ ID NO: 19135 - DNA, 24 bp, Homo sapiens
accatctgattggctttctgaggt

SEQ ID NO: 19136 - DNA, 24 bp, Homo sapiens
aaattggacttgcccgcgttcctg

SEQ ID NO: 19137 - DNA, 24 bp, Homo sapiens
gggatggtcgctttgtaatgtgct

SEQ ID NO: 19138 - DNA, 24 bp, Homo sapiens
ctcccgcttctccgtggtgacttg

SEQ ID NO: 19139 - DNA, 24 bp, Homo sapiens
catctgtgctccgtgccctcttcc

SEQ ID NO: 19140 - DNA, 24 bp, Homo sapiens
cacgctctcaagagaacgcacctg

SEQ ID NO: 19141 - DNA, 24 bp, Homo sapiens
tccgtgcccttgcttctgactttc

SEQ ID NO: 19142 - DNA, 24 bp, Homo sapiens
ctcccgcttctccgtggtgacttg

SEQ ID NO: 19143 - DNA, 24 bp, Homo sapiens
gggacaagtaagtcaatgtgggca

SEQ ID NO: 19144 - DNA, 24 bp, Homo sapiens
tttcatctggctccccccaccacc

SEQ ID NO: 19145 - DNA, 24 bp, Homo sapiens
tcgtctgggttttttccccttttc

SEQ ID NO: 19146 - DNA, 24 bp, Homo sapiens
ccgtgcccttgcttctgactttcg

SEQ ID NO: 19147 - DNA, 24 bp, Homo sapiens
tccgtgcccttgcttctgactttc

SEQ ID NO: 19148 - DNA, 24 bp, Homo sapiens
atccgtgcccttgcttctgacttt

SEQ ID NO: 19149 - DNA, 24 bp, Homo sapiens
catctgtgctccgtgccctcttcc

SEQ ID NO: 19150 - DNA, 24 bp, Homo sapiens
ctcccgcttctccgtggtgacttg

SEQ ID NO: 19151 - DNA, 24 bp, Homo sapiens
cacgctctcaagagaacgcacctg

SEQ ID NO: 19152 - DNA, 25 bp, Homo sapiens
ctgcctaccgagttcaagcgattct

SEQ ID NO: 19153 - DNA, 25 bp, Homo sapiens
cctgtaccgtcatgcctggctaatt

SEQ ID NO: 19154 - DNA, 23 bp, Homo sapiens
ctactcgcccacctggatgtccc

SEQ ID NO: 19155 - DNA, 24 bp, Homo sapiens
tgccactgcactccagtctgggtg

SEQ ID NO: 19156 - DNA, 24 bp, Homo sapiens
atgccactgcactccagtctgggt

SEQ ID NO: 19157 - DNA, 24 bp, Homo sapiens
catgccactgcactccagtctggg

SEQ ID NO: 19158 - DNA, 24 bp, Homo sapiens
tgtccccaccgcctgaggagtctc

SEQ ID NO: 19159 - DNA, 24 bp, Homo sapiens
ttgtccccaccgcctgaggagtct

SEQ ID NO: 19160 - DNA, 24 bp, Homo sapiens
cttgtccccaccgcctgaggagtc

SEQ ID NO: 19161 - DNA, 24 bp, Homo sapiens
agactacccagactggtcaagccg

SEQ ID NO: 19162 - DNA, 24 bp, Homo sapiens
aagactacccagactggtcaagcc

SEQ ID NO: 19163 - DNA, 24 bp, Homo sapiens
caagactacccagactggtcaagc

SEQ ID NO: 19164 - DNA, 24 bp, Homo sapiens
ccccctacctgcaaaaggccaaag

SEQ ID NO: 19165 - DNA, 24 bp, Homo sapiens
gccccctacctgcaaaaggccaaa

SEQ ID NO: 19166 - DNA, 24 bp, Homo sapiens
agccccctacctgcaaaaggccaa

SEQ ID NO: 19167 - DNA, 24 bp, Homo sapiens
aggtgcagaagcaggctgagagcc

SEQ ID NO: 19168 - DNA, 24 bp, Homo sapiens
aaggtgcagaagcaggctgagagc

SEQ ID NO: 19169 - DNA, 24 bp, Homo sapiens
caaggtgcagaagcaggctgagag

SEQ ID NO: 19170 - DNA, 24 bp, Homo sapiens
gaggatgtcaggatggagagtgat

SEQ ID NO: 19171 - DNA, 24 bp, Homo sapiens
tgaggatgtcaggatggagagtga

SEQ ID NO: 19172 - DNA, 24 bp, Homo sapiens
ctgaggatgtcaggatggagagtg

SEQ ID NO: 19173 - DNA, 24 bp, Homo sapiens
cagcatcccagtcttcccagatac

SEQ ID NO: 19174 - DNA, 24 bp, Homo sapiens
acagcatcccagtcttcccagata

SEQ ID NO: 19175 - DNA, 24 bp, Homo sapiens
gacagcatcccagtcttcccagat

SEQ ID NO: 19176 - DNA, 24 bp, Homo sapiens
ctgcagacaagaacctgaatggcg

SEQ ID NO: 19177 - DNA, 24 bp, Homo sapiens
gctgcagacaagaacctgaatggc

SEQ ID NO: 19178 - DNA, 24 bp, Homo sapiens
tgctgcagacaagaacctgaatgg

SEQ ID NO: 19179 - DNA, 24 bp, Homo sapiens
tgagggtcctggtgggaaggaaaa

SEQ ID NO: 19180 - DNA, 24 bp, Homo sapiens
ctgagggtcctggtgggaaggaaa

SEQ ID NO: 19181 - DNA, 24 bp, Homo sapiens
gctgagggtcctggtgggaaggaa

SEQ ID NO: 19182 - DNA, 24 bp, Homo sapiens
tcacctcccaggccccataccctg

SEQ ID NO: 19183 - DNA, 24 bp, Homo sapiens
atcacctcccaggccccataccct

SEQ ID NO: 19184 - DNA, 24 bp, Homo sapiens
tatcacctcccaggccccataccc

SEQ ID NO: 19185 - DNA, 24 bp, Homo sapiens
acgaagagcagaatcgaggcatct

SEQ ID NO: 19186 - DNA, 24 bp, Homo sapiens
tacgaagagcagaatcgaggcatc

SEQ ID NO: 19187 - DNA, 24 bp, Homo sapiens
ctacgaagagcagaatcgaggcat

SEQ ID NO: 19188 - DNA, 24 bp, Homo sapiens
gtgtgtagcagattttcaccccca

SEQ ID NO: 19189 - DNA, 24 bp, Homo sapiens
ggtgtgtagcagattttcaccccc

SEQ ID NO: 19190 - DNA, 24 bp, Homo sapiens
cggtgtgtagcagattttcacccc

SEQ ID NO: 19191 - DNA, 24 bp, Homo sapiens
atcagagcaccttcacaggcgaga

SEQ ID NO: 19192 - DNA, 24 bp, Homo sapiens
gcactccaagtcatctcagtaccg

SEQ ID NO: 19193 - DNA, 24 bp, Homo sapiens
gtgtacctggctcgctcccgtatc

SEQ ID NO: 19194 - DNA, 24 bp, Homo sapiens
ctctatgcaacccaaggaaccagg

SEQ ID NO: 19195 - DNA, 24 bp, Homo sapiens
ccaagggcagccaaagggtgggca

SEQ ID NO: 19196 - DNA, 24 bp, Homo sapiens
gatacccccactgacgagcccgat

SEQ ID NO: 19197 - DNA, 24 bp, Homo sapiens
aggtcagactatccgctccgttgc

SEQ ID NO: 19198 - DNA, 24 bp, Homo sapiens
ggaactgcctgctcactcttggaa

SEQ ID NO: 19199 - DNA, 24 bp, Homo sapiens
cctgcctggacactgctctgactg

SEQ ID NO: 19200 - DNA, 24 bp, Homo sapiens
cacctgaagcatctcgcctgtctc

SEQ ID NO: 19201 - DNA, 24 bp, Homo sapiens
ctgtcgccaccacctgaggaattg

SEQ ID NO: 19202 - DNA, 24 bp, Homo sapiens
aggcatctcgtctgttcccaccat

SEQ ID NO: 19203 - DNA, 24 bp, Homo sapiens
tgcctgtggtgtcacgcctgtctc

SEQ ID NO: 19204 - DNA, 24 bp, Homo sapiens
accacctgaggactcgcctatgtc

SEQ ID NO: 19205 - DNA, 24 bp, Homo sapiens
aggcatctcgtctgttcccaccat

SEQ ID NO: 19206 - DNA, 24 bp, Homo sapiens
ggcaaagaggagaccgaggaaagc

SEQ ID NO: 19207 - DNA, 24 bp, Homo sapiens
cggaaatcccacacacgcacgaaa

SEQ ID NO: 19208 - DNA, 24 bp, Homo sapiens
ggtgatacctgctgacctgcctgc

SEQ ID NO: 19209 - DNA, 24 bp, Homo sapiens
gccctgatgtggagcctggcaaag

SEQ ID NO: 19210 - DNA, 24 bp, Homo sapiens
agtgcgaaattaaactggagggcc

SEQ ID NO: 19211 - DNA, 24 bp, Homo sapiens
ccgaggaaagcaaaaaacgcaagc

SEQ ID NO: 19212 - DNA, 24 bp, Homo sapiens
cggaaatcccacacacgcacgaaa

SEQ ID NO: 19213 - DNA, 24 bp, Homo sapiens
ggtgatacctgctgacctgcctgc

SEQ ID NO: 19214 - DNA, 24 bp, Homo sapiens
gagaagaagaagcaacagcggcga

SEQ ID NO: 19215 - DNA, 24 bp, Homo sapiens
cggaaatcccacacacgcacgaaa

SEQ ID NO: 19216 - DNA, 24 bp, Homo sapiens
ggcaaagaggagaccgaggaaagc

SEQ ID NO: 19217 - DNA, 24 bp, Homo sapiens
caagggtgaaggtggtgtggagca

SEQ ID NO: 19218 - DNA, 24 bp, Homo sapiens
cagcagcccaatggactcctaccc

SEQ ID NO: 19219 - DNA, 24 bp, Homo sapiens
ctataaccagcggagtcttcagcg

SEQ ID NO: 19220 - DNA, 24 bp, Homo sapiens
atctcgcctgtgctctatgccaac

SEQ ID NO: 19221 - DNA, 24 bp, Homo sapiens
ctataaccagcggagtcttcagcg

SEQ ID NO: 19222 - DNA, 24 bp, Homo sapiens
atctcgcctgtgctctatgccaac

SEQ ID NO: 19223 - DNA, 24 bp, Homo sapiens
tctcaagcaagactacccagactg

SEQ ID NO: 19224 - DNA, 24 bp, Homo sapiens
ggcagctcaccgcatcaacaaggt

SEQ ID NO: 19225 - DNA, 24 bp, Homo sapiens
gccagatcaacaagcagaccaagg

SEQ ID NO: 19226 - DNA, 24 bp, Homo sapiens
atagcccgtaagactgaccgaccg

SEQ ID NO: 19227 - DNA, 24 bp, Homo sapiens
ataaccgggcagctcaccgcatca

SEQ ID NO: 19228 - DNA, 24 bp, Homo sapiens
atagcccgtaagactgaccgaccg

SEQ ID NO: 19229 - DNA, 24 bp, Homo sapiens
cggcttgtctacctctgcggacgg

SEQ ID NO: 19230 - DNA, 24 bp, Homo sapiens
ccttcgcaggacccctttggactg

SEQ ID NO: 19231 - DNA, 24 bp, Homo sapiens
tggcacctggtatgaacagacagc

SEQ ID NO: 19232 - DNA, 24 bp, Homo sapiens
tcaagaaagtgatggctcagggca

SEQ ID NO: 19233 - DNA, 24 bp, Homo sapiens
acagccagtgctatcacagaagcc

SEQ ID NO: 19234 - DNA, 24 bp, Homo sapiens
ggatggagagtgatgaggatagcg

SEQ ID NO: 19235 - DNA, 24 bp, Homo sapiens
gcatcccagtcttcccagatacca

SEQ ID NO: 19236 - DNA, 24 bp, Homo sapiens
aaagggcaaaggaagtgaggtgtc

SEQ ID NO: 19237 - DNA, 24 bp, Homo sapiens
tagacctgctggctgccttgccta

SEQ ID NO: 19238 - DNA, 24 bp, Homo sapiens
agcgattctcctgacagcattgtg

SEQ ID NO: 19239 - DNA, 24 bp, Homo sapiens
cctcgtttccctcatctgggctca

SEQ ID NO: 19240 - DNA, 24 bp, Homo sapiens
ctctcccctgtcatccccctcatt

SEQ ID NO: 19241 - DNA, 24 bp, Homo sapiens
aaagggcaaaggaagtgaggtgtc

SEQ ID NO: 19242 - DNA, 24 bp, Homo sapiens
acaagaacctgaatggcgtgatgg

SEQ ID NO: 19243 - DNA, 24 bp, Homo sapiens
ccaactcctatgaggtgctgttcc

SEQ ID NO: 19244 - DNA, 24 bp, Homo sapiens
ccaactcctatgaggtgctgttcc

SEQ ID NO: 19245 - DNA, 24 bp, Homo sapiens
cagtggcggagctgctgagcatga

SEQ ID NO: 19246 - DNA, 24 bp, Homo sapiens
ggggaggcactgagccaaagaagg

SEQ ID NO: 19247 - DNA, 24 bp, Homo sapiens
aggaagtgaggtgtcagtcatgct

SEQ ID NO: 19248 - DNA, 24 bp, Homo sapiens
gcatcccagtcttcccagatacca

SEQ ID NO: 19249 - DNA, 24 bp, Homo sapiens
ggatggagagtgatgaggatagcg

SEQ ID NO: 19250 - DNA, 24 bp, Homo sapiens
agtgttggctggctataccctgaa

SEQ ID NO: 19251 - DNA, 24 bp, Homo sapiens
ccaactcctatgaggtgctgttcc

SEQ ID NO: 19252 - DNA, 24 bp, Homo sapiens
acaagaacctgaatggcgtgatgg

SEQ ID NO: 19253 - DNA, 24 bp, Homo sapiens
ctgacatgctgcgactcttccctg

SEQ ID NO: 19254 - DNA, 24 bp, Homo sapiens
agctctttgggctgacggtgcatg

SEQ ID NO: 19255 - DNA, 24 bp, Homo sapiens
ttgagcctgtggctgccatgagaa

SEQ ID NO: 19256 - DNA, 24 bp, Homo sapiens
aaatcctcacacactacaaacggc

SEQ ID NO: 19257 - DNA, 24 bp, Homo sapiens
atcagagcaccttcacaggcgaga

SEQ ID NO: 19258 - DNA, 24 bp, Homo sapiens
gcactccaagtcatctcagtaccg

SEQ ID NO: 19259 - DNA, 24 bp, Homo sapiens
atgtgattgatgctacgttgaccg

SEQ ID NO: 19260 - DNA, 24 bp, Homo sapiens
aggtacattaaccattcctgtgcc

SEQ ID NO: 19261 - DNA, 24 bp, Homo sapiens
gccgaagtcgtgacatttgacaaa

SEQ ID NO: 19262 - DNA, 24 bp, Homo sapiens
gtcttcccaagtgccgatgaaata

SEQ ID NO: 19263 - DNA, 24 bp, Homo sapiens
agtcttcccaagtgccgatgaaat

SEQ ID NO: 19264 - DNA, 24 bp, Homo sapiens
gagtcttcccaagtgccgatgaaa

SEQ ID NO: 19265 - DNA, 24 bp, Homo sapiens
tgctggaaaccctgaaagaactga

SEQ ID NO: 19266 - DNA, 24 bp, Homo sapiens
gctcacttctcaggactgtatggc

SEQ ID NO: 19267 - DNA, 24 bp, Homo sapiens
caaatgtgtggtaaagcagggaca

SEQ ID NO: 19268 - DNA, 24 bp, Homo sapiens
agtggccctgctagatgactcagt

SEQ ID NO: 19269 - DNA, 24 bp, Homo sapiens
atggcacccccacaccaacaagtt

SEQ ID NO: 19270 - DNA, 24 bp, Homo sapiens
aagaactgccttcatccatcaccg

SEQ ID NO: 19271 - DNA, 24 bp, Homo sapiens
atcaacatttggcgtgatgtgggc

SEQ ID NO: 19272 - DNA, 24 bp, Homo sapiens
gtgtttgagtgggtgaagacggca

SEQ ID NO: 19273 - DNA, 24 bp, Homo sapiens
ccccatctgtctctcaggagcgaa

SEQ ID NO: 19274 - DNA, 24 bp, Homo sapiens
atcgctgaatttgcccaagtcaca

SEQ ID NO: 19275 - DNA, 24 bp, Homo sapiens
gcatccggctgggccctggcactc

SEQ ID NO: 19276 - DNA, 24 bp, Homo sapiens
gcattcttatctggaccctggacc

SEQ ID NO: 19277 - DNA, 24 bp, Homo sapiens
tcagtccgtgtgtataatgccagc

SEQ ID NO: 19278 - DNA, 24 bp, Homo sapiens
tcgctgaatttgcccaagtcacaa

SEQ ID NO: 19279 - DNA, 24 bp, Homo sapiens
agcgattctcctgcctcagcctcc

SEQ ID NO: 19280 - DNA, 24 bp, Homo sapiens
tggattcaagcgattctcctgcct

SEQ ID NO: 19281 - DNA, 24 bp, Homo sapiens
aatctcggctctccgcaacctcca

SEQ ID NO: 19282 - DNA, 24 bp, Homo sapiens
gcttccagccagaagcctgcctgg

SEQ ID NO: 19283 - DNA, 24 bp, Homo sapiens
agcttccagccagaagcctgcctg

SEQ ID NO: 19284 - DNA, 24 bp, Homo sapiens
aagcttccagccagaagcctgcct

SEQ ID NO: 19285 - DNA, 24 bp, Homo sapiens
gattacaggcacccaccaccacac

SEQ ID NO: 19286 - DNA, 25 bp, Homo sapiens
agagacagggtttcaccatgttggc

SEQ ID NO: 19287 - DNA, 24 bp, Homo sapiens
aatctcggctcattgcaacctcca

SEQ ID NO: 19288 - DNA, 24 bp, Homo sapiens
cggggcagaagagattgtggacgg

SEQ ID NO: 19289 - DNA, 24 bp, Homo sapiens
tcggggcagaagagattgtggacg

SEQ ID NO: 19290 - DNA, 24 bp, Homo sapiens
atcggggcagaagagattgtggac

SEQ ID NO: 19291 - DNA, 24 bp, Homo sapiens
tcaccaacctgaacaatgccttcg

SEQ ID NO: 19292 - DNA, 24 bp, Homo sapiens
ggatggtcttgccttcaatgccct

SEQ ID NO: 19293 - DNA, 24 bp, Homo sapiens
taggttcgccatccaggacatctc

SEQ ID NO: 19294 - DNA, 24 bp, Homo sapiens
tccagactcacttgccattgccag

SEQ ID NO: 19295 - DNA, 24 bp, Homo sapiens
ggatggtcttgccttcaatgccct

SEQ ID NO: 19296 - DNA, 24 bp, Homo sapiens
agtatgacaagctgaggaaggacg

SEQ ID NO: 19297 - DNA, 24 bp, Homo sapiens
tcaccaacctgaacaatgccttcg

SEQ ID NO: 19298 - DNA, 24 bp, Homo sapiens
tgaagcagtatgaacgcagcatcg

SEQ ID NO: 19299 - DNA, 24 bp, Homo sapiens
ttgagatgaacgggaccctggagg

SEQ ID NO: 19300 - DNA, 24 bp, Homo sapiens
ccagaccaagatggaggagatcgg

SEQ ID NO: 19301 - DNA, 25 bp, Homo sapiens
agcagtcttggtggacctagaacct

SEQ ID NO: 19302 - DNA, 24 bp, Homo sapiens
tagaggtggtgaggcacgagagtg

SEQ ID NO: 19303 - DNA, 23 bp, Homo sapiens
agggcttccagatcgtccactcc

SEQ ID NO: 19304 - DNA, 23 bp, Homo sapiens
cacacctgccaagtctctccgac

SEQ ID NO: 19305 - DNA, 23 bp, Homo sapiens
ctcgacctagcccaccctctcag

SEQ ID NO: 19306 - DNA, 23 bp, Homo sapiens
gctgacacctgcccagtggaagc

SEQ ID NO: 19307 - DNA, 24 bp, Homo sapiens
atgggaggaagaaacgactacaga

SEQ ID NO: 19308 - DNA, 24 bp, Homo sapiens
aatgggaggaagaaacgactacag

SEQ ID NO: 19309 - DNA, 24 bp, Homo sapiens
aaatgggaggaagaaacgactaca

SEQ ID NO: 19310 - DNA, 24 bp, Homo sapiens
aacagatgctgattcagaatctga

SEQ ID NO: 19311 - DNA, 24 bp, Homo sapiens
gaacagatgctgattcagaatctg

SEQ ID NO: 19312 - DNA, 24 bp, Homo sapiens
agaacagatgctgattcagaatct

SEQ ID NO: 19313 - DNA, 24 bp, Homo sapiens
ggatgaagcagtgggttccagtcc

SEQ ID NO: 19314 - DNA, 24 bp, Homo sapiens
gggatgaagcagtgggttccagtc

SEQ ID NO: 19315 - DNA, 24 bp, Homo sapiens
tgggatgaagcagtgggttccagt

SEQ ID NO: 19316 - DNA, 25 bp, Homo sapiens
tgatggtggttggacagtcagcatt

SEQ ID NO: 19317 - DNA, 25 bp, Homo sapiens
gatggagatggacacatggatcatt

SEQ ID NO: 19318 - DNA, 24 bp, Homo sapiens
atctgggatgaagcagtgggttcc

SEQ ID NO: 19319 - DNA, 24 bp, Homo sapiens
ggatgaagcagcaaccagcaggcc

SEQ ID NO: 19320 - DNA, 24 bp, Homo sapiens
gggatgaagcagcaaccagcaggc

SEQ ID NO: 19321 - DNA, 24 bp, Homo sapiens
tgggatgaagcagcaaccagcagg

SEQ ID NO: 19322 - DNA, 23 bp, Homo sapiens
cgtgcttggtttaggtcggagcg

SEQ ID NO: 19323 - DNA, 25 bp, Homo sapiens
ccgcacatttagctctccaactacc

SEQ ID NO: 19324 - DNA, 25 bp, Homo sapiens
ttgaccatctctacgttggtattcc

SEQ ID NO: 19325 - DNA, 23 bp, Homo sapiens
ctccgcagccagaccttgacaca

SEQ ID NO: 19326 - DNA, 23 bp, Homo sapiens
cactccgccagaaggtcgccagg

SEQ ID NO: 19327 - DNA, 23 bp, Homo sapiens
tccctgcccaacccttactgacg

SEQ ID NO: 19328 - DNA, 24 bp, Homo sapiens
agagcagccaggactgagtggacg

SEQ ID NO: 19329 - DNA, 24 bp, Homo sapiens
cagagcagccaggactgagtggac

SEQ ID NO: 19330 - DNA, 24 bp, Homo sapiens
acagagcagccaggactgagtgga

SEQ ID NO: 19331 - DNA, 24 bp, Homo sapiens
ccacttcaggtccggcgtacattc

SEQ ID NO: 19332 - DNA, 25 bp, Homo sapiens
acaccatcctcagctcctaccttct

SEQ ID NO: 19333 - DNA, 24 bp, Homo sapiens
gccccagaaaagtcagtgtgtagg

SEQ ID NO: 19334 - DNA, 24 bp, Homo sapiens
gaacgcccaaggtgcacacatctt

SEQ ID NO: 19335 - DNA, 24 bp, Homo sapiens
cgaacgcccaaggtgcacacatct

SEQ ID NO: 19336 - DNA, 24 bp, Homo sapiens
gcgaacgcccaaggtgcacacatc

SEQ ID NO: 19337 - DNA, 24 bp, Homo sapiens
agttcatcaacccagagcaaacat

SEQ ID NO: 19338 - DNA, 23 bp, Homo sapiens
ctctgaaagccaacaagaattct

SEQ ID NO: 19339 - DNA, 24 bp, Homo sapiens
acttaaaactaataaagaggttcc

SEQ ID NO: 19340 - DNA, 24 bp, Homo sapiens
aggcattaaaggagaagctagagc

SEQ ID NO: 19341 - DNA, 24 bp, Homo sapiens
gaggcattaaaggagaagctagag

SEQ ID NO: 19342 - DNA, 24 bp, Homo sapiens
ggaggcattaaaggagaagctaga

SEQ ID NO: 19343 - DNA, 23 bp, Homo sapiens
gcaaaggaccaagcatcacgaaa

SEQ ID NO: 19344 - DNA, 25 bp, Homo sapiens
atggcaatggcacaaagttctctcg

SEQ ID NO: 19345 - DNA, 23 bp, Homo sapiens
ccgctcctcctcctcctggtctg

SEQ ID NO: 19346 - DNA, 24 bp, Homo sapiens
cccattcactgccccgactatctg

SEQ ID NO: 19347 - DNA, 24 bp, Homo sapiens
ccccattcactgccccgactatct

SEQ ID NO: 19348 - DNA, 24 bp, Homo sapiens
tccccattcactgccccgactatc

SEQ ID NO: 19349 - DNA, 24 bp, Homo sapiens
tgtcagcctgccctaggacttcat

SEQ ID NO: 19350 - DNA, 24 bp, Homo sapiens
gtgtcagcctgccctaggacttca

SEQ ID NO: 19351 - DNA, 24 bp, Homo sapiens
tgtgtcagcctgccctaggacttc

SEQ ID NO: 19352 - DNA, 25 bp, Homo sapiens
gccaagatgactgaggtgatgatga

SEQ ID NO: 19353 - DNA, 24 bp, Homo sapiens
caaactgaaggaccgtctgccctc

SEQ ID NO: 19354 - DNA, 25 bp, Homo sapiens
caagataactgcgaagagacagcga

SEQ ID NO: 19355 - DNA, 25 bp, Homo sapiens
gccaagatgactgaggtgatgatga

SEQ ID NO: 19356 - DNA, 24 bp, Homo sapiens
ttccccattcactgccccgactat

SEQ ID NO: 19357 - DNA, 23 bp, Homo sapiens
tgtcatcctcactcgggacgcag

SEQ ID NO: 19358 - DNA, 24 bp, Homo sapiens
gcaacatacaggtcctttctgaaa

SEQ ID NO: 19359 - DNA, 24 bp, Homo sapiens
agcaacatacaggtcctttctgaa

SEQ ID NO: 19360 - DNA, 24 bp, Homo sapiens
cagcaacatacaggtcctttctga

SEQ ID NO: 19361 - DNA, 24 bp, Homo sapiens
ccactcaccttccacctcctccat

SEQ ID NO: 19362 - DNA, 24 bp, Homo sapiens
actgctccacctctgattccacca

SEQ ID NO: 19363 - DNA, 25 bp, Homo sapiens
tgagaacagcaacatacaggtcctt

SEQ ID NO: 19364 - DNA, 23 bp, Homo sapiens
cacctcctccgactgtcagcact

SEQ ID NO: 19365 - DNA, 24 bp, Homo sapiens
ccactcaccttccacctcctccat

SEQ ID NO: 19366 - DNA, 25 bp, Homo sapiens
tgagaacagcaacatacaggtcctt

SEQ ID NO: 19367 - DNA, 24 bp, Homo sapiens
taatctgcccacctcggcctccca

SEQ ID NO: 19368 - DNA, 24 bp, Homo sapiens
gtaatctgcccacctcggcctccc

SEQ ID NO: 19369 - DNA, 24 bp, Homo sapiens
agtaatctgcccacctcggcctcc

SEQ ID NO: 19370 - DNA, 24 bp, Homo sapiens
gtcgcccaggtcctcggcctccca

SEQ ID NO: 19371 - DNA, 24 bp, Homo sapiens
tgtcgcccaggtcctcggcctccc

SEQ ID NO: 19372 - DNA, 24 bp, Homo sapiens
ctgtcgcccaggtcctcggcctcc

SEQ ID NO: 19373 - DNA, 24 bp, Homo sapiens
aagagtgacagtgctgtggagcat

SEQ ID NO: 19374 - DNA, 24 bp, Homo sapiens
gaagagtgacagtgctgtggagca

SEQ ID NO: 19375 - DNA, 24 bp, Homo sapiens
tgaagagtgacagtgctgtggagc

SEQ ID NO: 19376 - DNA, 24 bp, Homo sapiens
cctgcttccagtgctgtccccggc

SEQ ID NO: 19377 - DNA, 24 bp, Homo sapiens
ccctgcttccagtgctgtccccgg

SEQ ID NO: 19378 - DNA, 24 bp, Homo sapiens
accctgcttccagtgctgtccccg

SEQ ID NO: 19379 - DNA, 24 bp, Homo sapiens
tttcccgaaccaccctatcctgat

SEQ ID NO: 19380 - DNA, 25 bp, Homo sapiens
gatgaagagggcactgaaggaacca

SEQ ID NO: 19381 - DNA, 25 bp, Homo sapiens
ggtatcggtacagcaatcggagagc

SEQ ID NO: 19382 - DNA, 24 bp, Homo sapiens
ggcgtggtttggttttgctggcac

SEQ ID NO: 19383 - DNA, 24 bp, Homo sapiens
aggcgtggtttggttttgctggca

SEQ ID NO: 19384 - DNA, 24 bp, Homo sapiens
caggcgtggtttggttttgctggc

SEQ ID NO: 19385 - DNA, 24 bp, Homo sapiens
atgcgatgccggtcatctttggaa

SEQ ID NO: 19386 - DNA, 24 bp, Homo sapiens
aatgcgatgccggtcatctttgga

SEQ ID NO: 19387 - DNA, 24 bp, Homo sapiens
caatgcgatgccggtcatctttgg

SEQ ID NO: 19388 - DNA, 24 bp, Homo sapiens
tgggatattcatggctgccaattc

SEQ ID NO: 19389 - DNA, 24 bp, Homo sapiens
ctgggatattcatggctgccaatt

SEQ ID NO: 19390 - DNA, 24 bp, Homo sapiens
cctgggatattcatggctgccaat

SEQ ID NO: 19391 - DNA, 24 bp, Homo sapiens
gtgtattttagatcgccgatcgca

SEQ ID NO: 19392 - DNA, 24 bp, Homo sapiens
tgtgtattttagatcgccgatcgc

SEQ ID NO: 19393 - DNA, 24 bp, Homo sapiens
ttgtgtattttagatcgccgatcg

SEQ ID NO: 19394 - DNA, 24 bp, Homo sapiens
ccagcaaaaaggtactgaagagag

SEQ ID NO: 19395 - DNA, 24 bp, Homo sapiens
gccagcaaaaaggtactgaagaga

SEQ ID NO: 19396 - DNA, 24 bp, Homo sapiens
agccagcaaaaaggtactgaagag

SEQ ID NO: 19397 - DNA, 23 bp, Homo sapiens
gcaaggctctgtgggagctactg

SEQ ID NO: 19398 - DNA, 25 bp, Homo sapiens
cgagcggaaaattccagaactgtac

SEQ ID NO: 19399 - DNA, 25 bp, Homo sapiens
ccatacttgttgcctgctgttgaga

SEQ ID NO: 19400 - DNA, 25 bp, Homo sapiens
gtcacctggctcgatggcattaagt

SEQ ID NO: 19401 - DNA, 25 bp, Homo sapiens
cagtacagcctcgtggtgttcaaca

SEQ ID NO: 19402 - DNA, 25 bp, Homo sapiens
cagtacagcctcgtggtgttcaaca

SEQ ID NO: 19403 - DNA, 23 bp, Homo sapiens
tcctgctgagacggacttcgggg

SEQ ID NO: 19404 - DNA, 24 bp, Homo sapiens
cgctcccgagtcctacgtacaatg

SEQ ID NO: 19405 - DNA, 24 bp, Homo sapiens
ggcagcagtcagtctccaataagc

SEQ ID NO: 19406 - DNA, 24 bp, Homo sapiens
gggtcctggagtggcaagagaaac

SEQ ID NO: 19407 - DNA, 23 bp, Homo sapiens
gcctcagtggatgccaacaccaa

SEQ ID NO: 19408 - DNA, 23 bp, Homo sapiens
gtacaatgtcacgctcccaccag

SEQ ID NO: 19409 - DNA, 25 bp, Homo sapiens
gtcacctggctcgatggcattaagt

SEQ ID NO: 19410 - DNA, 25 bp, Homo sapiens
ccatacttgttgcctgctgttgaga

SEQ ID NO: 19411 - DNA, 24 bp, Homo sapiens
cgctcccgagtcctacgtacaatg

SEQ ID NO: 19412 - DNA, 23 bp, Homo sapiens
agcctcgtggtgttcaacacagt

SEQ ID NO: 19413 - DNA, 24 bp, Homo sapiens
accagcagcgcctatgagtttgtc

SEQ ID NO: 19414 - DNA, 23 bp, Homo sapiens
gtacaatgtcacgctcccaccag

SEQ ID NO: 19415 - DNA, 25 bp, Homo sapiens
cagtacagcctcgtggtgttcaaca

SEQ ID NO: 19416 - DNA, 23 bp, Homo sapiens
atggtggtcctcctgctgagacg

SEQ ID NO: 19417 - DNA, 23 bp, Homo sapiens
cacaagcaggtccagcagcagaa

SEQ ID NO: 19418 - DNA, 23 bp, Homo sapiens
agagcggcttcgtcaacggcatc

SEQ ID NO: 19419 - DNA, 24 bp, Homo sapiens
gctcatgctcctgtactcgtccaa

SEQ ID NO: 19420 - DNA, 25 bp, Homo sapiens
aaagcaaactcttccgaaatcctgt

SEQ ID NO: 19421 - DNA, 25 bp, Homo sapiens
gattctcgttggctgatggaactat

SEQ ID NO: 19422 - DNA, 24 bp, Homo sapiens
gcacgccgcattactacaggagaa

SEQ ID NO: 19423 - DNA, 23 bp, Homo sapiens
tgcaccagctccaccattcctag

SEQ ID NO: 19424 - DNA, 25 bp, Homo sapiens
cacttcttagatacctgctggacag

SEQ ID NO: 19425 - DNA, 24 bp, Homo sapiens
gtcactgttacaagagaagcaccg

SEQ ID NO: 19426 - DNA, 23 bp, Homo sapiens
tgcaccagctccaccattcctag

SEQ ID NO: 19427 - DNA, 25 bp, Homo sapiens
cacttcttagatacctgctggacag

SEQ ID NO: 19428 - DNA, 25 bp, Homo sapiens
acggaaatgttgtcaagcaggagca

SEQ ID NO: 19429 - DNA, 24 bp, Homo sapiens
tcaatcaataggaggatgaaattt

SEQ ID NO: 19430 - DNA, 24 bp, Homo sapiens
ttcaatcaataggaggatgaaatt

SEQ ID NO: 19431 - DNA, 24 bp, Homo sapiens
tttcaatcaataggaggatgaaat

SEQ ID NO: 19432 - DNA, 24 bp, Homo sapiens
tgcctggagtgataatgtcactgc

SEQ ID NO: 19433 - DNA, 24 bp, Homo sapiens
ttgcctggagtgataatgtcactg

SEQ ID NO: 19434 - DNA, 24 bp, Homo sapiens
tttgcctggagtgataatgtcact

SEQ ID NO: 19435 - DNA, 24 bp, Homo sapiens
ttttcctccagatagcacaacgat

SEQ ID NO: 19436 - DNA, 24 bp, Homo sapiens
tttttcctccagatagcacaacga

SEQ ID NO: 19437 - DNA, 24 bp, Homo sapiens
ttttttcctccagatagcacaacg

SEQ ID NO: 19438 - DNA, 24 bp, Homo sapiens
aacgaatggcagaatggatacagc

SEQ ID NO: 19439 - DNA, 24 bp, Homo sapiens
gaacgaatggcagaatggatacag

SEQ ID NO: 19440 - DNA, 24 bp, Homo sapiens
tgaacgaatggcagaatggataca

SEQ ID NO: 19441 - DNA, 24 bp, Homo sapiens
gcttcaagggttccaggacaagaa

SEQ ID NO: 19442 - DNA, 25 bp, Homo sapiens
catcgacatggtaatcctgaggagg

SEQ ID NO: 19443 - DNA, 25 bp, Homo sapiens
acgaatggcagaatggatacagcag

SEQ ID NO: 19444 - DNA, 25 bp, Homo sapiens
acgaatggcagaatggatacagcag

SEQ ID NO: 19445 - DNA, 25 bp, Homo sapiens
tgcgagatagtcttcatcagccaca

SEQ ID NO: 19446 - DNA, 23 bp, Homo sapiens
gggcagcacaggcagggaaacat

SEQ ID NO: 19447 - DNA, 23 bp, Homo sapiens
gctgtggctatgtgctcctcagg

SEQ ID NO: 19448 - DNA, 25 bp, Homo sapiens
gagcctatatgatggatgacttgga

SEQ ID NO: 19449 - DNA, 25 bp, Homo sapiens
acctttgtgatcgtgaagcctgttt

SEQ ID NO: 19450 - DNA, 25 bp, Homo sapiens
agagatatacacgaaccttggtcca

SEQ ID NO: 19451 - DNA, 25 bp, Homo sapiens
tcgtctgaaggcttcctatgacaca

SEQ ID NO: 19452 - DNA, 25 bp, Homo sapiens
ggcagacaggttgatgacttggagg

SEQ ID NO: 19453 - DNA, 25 bp, Homo sapiens
agagatatacacgaaccttggtcca

SEQ ID NO: 19454 - DNA, 25 bp, Homo sapiens
atgatattgccagcagagctataga

SEQ ID NO: 19455 - DNA, 25 bp, Homo sapiens
agagatatacacgaaccttggtcca

SEQ ID NO: 19456 - DNA, 24 bp, Homo sapiens
ctttggagggtcgtgattcagagt

SEQ ID NO: 19457 - DNA, 25 bp, Homo sapiens
gagcctatatgatggatgacttgga

SEQ ID NO: 19458 - DNA, 25 bp, Homo sapiens
gccgccagatagcacaacgatagaa

SEQ ID NO: 19459 - DNA, 24 bp, Homo sapiens
aagcagccttagtccatctcttga

SEQ ID NO: 19460 - DNA, 23 bp, Homo sapiens
tggtccttcagcctcacaagtgc

SEQ ID NO: 19461 - DNA, 25 bp, Homo sapiens
agtgatggtcccaatccagaagtgg

SEQ ID NO: 19462 - DNA, 23 bp, Homo sapiens
acacagataagttccaatatgcc

SEQ ID NO: 19463 - DNA, 23 bp, Homo sapiens
ccctgatagctcttctgattcct

SEQ ID NO: 19464 - DNA, 24 bp, Homo sapiens
aagcagccttagtccatctcttga

SEQ ID NO: 19465 - DNA, 23 bp, Homo sapiens
tggtccttcagcctcacaagtgc

SEQ ID NO: 19466 - DNA, 25 bp, Homo sapiens
gcacctctggctgatgattcctctg

SEQ ID NO: 19467 - DNA, 24 bp, Homo sapiens
aagcagccttagtccatctcttga

SEQ ID NO: 19468 - DNA, 24 bp, Homo sapiens
tttctttggtccttcagcctcaca

SEQ ID NO: 19469 - DNA, 25 bp, Homo sapiens
agagctatttgtttagaccatgcca

SEQ ID NO: 19470 - DNA, 25 bp, Homo sapiens
gcacctctggctgatgattcctctg

SEQ ID NO: 19471 - DNA, 24 bp, Homo sapiens
ctatggtcatgttcgagctgtggc

SEQ ID NO: 19472 - DNA, 25 bp, Homo sapiens
ttgtcagccaggtgtagaaggtgtg

SEQ ID NO: 19473 - DNA, 25 bp, Homo sapiens
gcacctctggctgatgattcctctg

SEQ ID NO: 19474 - DNA, 23 bp, Homo sapiens
cttgtcagccaggtgtagaaggt

SEQ ID NO: 19475 - DNA, 25 bp, Homo sapiens
tggctatggtcatgttcgagctgtg

SEQ ID NO: 19476 - DNA, 24 bp, Homo sapiens
aagcagccttagtccatctcttga

SEQ ID NO: 19477 - DNA, 25 bp, Homo sapiens
gccgccagatagcacaacgatagaa

SEQ ID NO: 19478 - DNA, 25 bp, Homo sapiens
gctgtttgcctggagtgataatgtc

SEQ ID NO: 19479 - DNA, 24 bp, Homo sapiens
gatctgccaaggctgcccacatag

SEQ ID NO: 19480 - DNA, 25 bp, Homo sapiens
gcgatttgactatgactgggaaaga

SEQ ID NO: 19481 - DNA, 25 bp, Homo sapiens
tggacatggaaccttacacagttgc

SEQ ID NO: 19482 - DNA, 24 bp, Homo sapiens
gcccacccgcggactggcagccac

SEQ ID NO: 19483 - DNA, 24 bp, Homo sapiens
cgcccacccgcggactggcagcca

SEQ ID NO: 19484 - DNA, 24 bp, Homo sapiens
ccgcccacccgcggactggcagcc

SEQ ID NO: 19485 - DNA, 24 bp, Homo sapiens
cccaaccccaatgagcagtagcag

SEQ ID NO: 19486 - DNA, 24 bp, Homo sapiens
ccccaaccccaatgagcagtagca

SEQ ID NO: 19487 - DNA, 24 bp, Homo sapiens
accccaaccccaatgagcagtagc

SEQ ID NO: 19488 - DNA, 24 bp, Homo sapiens
tcagtatatcaaggagcagcgtgg

SEQ ID NO: 19489 - DNA, 24 bp, Homo sapiens
attgtggactcggagaagacaggc

SEQ ID NO: 19490 - DNA, 24 bp, Homo sapiens
ccgcctcattgacctatgccagcc

SEQ ID NO: 19491 - DNA, 24 bp, Homo sapiens
cgagagagggaaatgaaagacttg

SEQ ID NO: 19492 - DNA, 24 bp, Homo sapiens
gtgagctagccaactttgggcctc

SEQ ID NO: 19493 - DNA, 24 bp, Homo sapiens
aatgatatcaagaggatcattcag

SEQ ID NO: 19494 - DNA, 24 bp, Homo sapiens
tggctggagatgacatggaggtca

SEQ ID NO: 19495 - DNA, 24 bp, Homo sapiens
ctggctggagatgacatggaggtc

SEQ ID NO: 19496 - DNA, 24 bp, Homo sapiens
gctggctggagatgacatggaggt

SEQ ID NO: 19497 - DNA, 24 bp, Homo sapiens
aaaggtggcaggccatatacaaac

SEQ ID NO: 19498 - DNA, 24 bp, Homo sapiens
aaaaggtggcaggccatatacaaa

SEQ ID NO: 19499 - DNA, 24 bp, Homo sapiens
caaaaggtggcaggccatatacaa

SEQ ID NO: 19500 - DNA, 24 bp, Homo sapiens
cgccatgttccgtgccttcaaatc

SEQ ID NO: 19501 - DNA, 24 bp, Homo sapiens
acgccatgttccgtgccttcaaat

SEQ ID NO: 19502 - DNA, 24 bp, Homo sapiens
gacgccatgttccgtgccttcaaa

SEQ ID NO: 19503 - DNA, 23 bp, Homo sapiens
ggatagcgacaccacaggcaagc

SEQ ID NO: 19504 - DNA, 25 bp, Homo sapiens
ctcaataaggttgtgacacgacacc

SEQ ID NO: 19505 - DNA, 23 bp, Homo sapiens
gctggctggagatgacatggagg

SEQ ID NO: 19506 - DNA, 25 bp, Homo sapiens
tgttctctcagtacttgttacccag

SEQ ID NO: 19507 - DNA, 23 bp, Homo sapiens
catctttgtggggcctgctgacc

SEQ ID NO: 19508 - DNA, 23 bp, Homo sapiens
cggtctctcccagggccgatcct

SEQ ID NO: 19509 - DNA, 24 bp, Homo sapiens
agttccccctggctctaggacact

SEQ ID NO: 19510 - DNA, 24 bp, Homo sapiens
gagttccccctggctctaggacac

SEQ ID NO: 19511 - DNA, 24 bp, Homo sapiens
ggagttccccctggctctaggaca

SEQ ID NO: 19512 - DNA, 25 bp, Homo sapiens
tgacaaagatggcactggacaaatc

SEQ ID NO: 19513 - DNA, 23 bp, Homo sapiens
gacgccatgttccgtgccttcaa

SEQ ID NO: 19514 - DNA, 25 bp, Homo sapiens
agtgggaacatggattttgacaact

SEQ ID NO: 19515 - DNA, 25 bp, Homo sapiens
gacaaagatggcactggacaaatcc

SEQ ID NO: 19516 - DNA, 24 bp, Homo sapiens
agcaacagcagaattacaagcggc

SEQ ID NO: 19517 - DNA, 24 bp, Homo sapiens
cagcaacagcagaattacaagcgg

SEQ ID NO: 19518 - DNA, 24 bp, Homo sapiens
acagcaacagcagaattacaagcg

SEQ ID NO: 19519 - DNA, 24 bp, Homo sapiens
atacacagcagattcctccttatg

SEQ ID NO: 19520 - DNA, 24 bp, Homo sapiens
tatacacagcagattcctccttat

SEQ ID NO: 19521 - DNA, 24 bp, Homo sapiens
ttatacacagcagattcctcctta

SEQ ID NO: 19522 - DNA, 25 bp, Homo sapiens
actaacccatactcgcagcaacagg

SEQ ID NO: 19523 - DNA, 23 bp, Homo sapiens
cgtcaggaccgcagcaaggacat

SEQ ID NO: 19524 - DNA, 25 bp, Homo sapiens
gccagactccatattacaaccagca

SEQ ID NO: 19525 - DNA, 25 bp, Homo sapiens
acaccctgacctctttctctcctcc

SEQ ID NO: 19526 - DNA, 23 bp, Homo sapiens
cccacagtttggtcctcctccca

SEQ ID NO: 19527 - DNA, 25 bp, Homo sapiens
cctgagatcacctcttagaactggt

SEQ ID NO: 19528 - DNA, 23 bp, Homo sapiens
cgtcaggaccgcagcaaggacat

SEQ ID NO: 19529 - DNA, 25 bp, Homo sapiens
actaacccatactcgcagcaacagg

SEQ ID NO: 19530 - DNA, 25 bp, Homo sapiens
cagatgggcaagatgagacctcagc

SEQ ID NO: 19531 - DNA, 25 bp, Homo sapiens
gccagactccatattacaaccagca

SEQ ID NO: 19532 - DNA, 24 bp, Homo sapiens
aaccttcgtatcagcagcagccac

SEQ ID NO: 19533 - DNA, 24 bp, Homo sapiens
ctccagtcctctcagcctccatac

SEQ ID NO: 19534 - DNA, 23 bp, Homo sapiens
cgtcaggaccgcagcaaggacat

SEQ ID NO: 19535 - DNA, 25 bp, Homo sapiens
actaacccatactcgcagcaacagg

SEQ ID NO: 19536 - DNA, 25 bp, Homo sapiens
tggatcagatgggcaagatgagacc

SEQ ID NO: 19537 - DNA, 25 bp, Homo sapiens
ggaactggacctccttatggacaag

SEQ ID NO: 19538 - DNA, 25 bp, Homo sapiens
tgaacaacaaggcagatgggacacc

SEQ ID NO: 19539 - DNA, 25 bp, Homo sapiens
tggtgagcctgagaggaagatgtgg

SEQ ID NO: 19540 - DNA, 25 bp, Homo sapiens
tgattccaagaagtcccagcccaag

SEQ ID NO: 19541 - DNA, 25 bp, Homo sapiens
tgtgaaggagattggtggattgact

SEQ ID NO: 19542 - DNA, 24 bp, Homo sapiens
aacctctggacctctatcgcctct

SEQ ID NO: 19543 - DNA, 24 bp, Homo sapiens
ttcaagcgattctccagcctcagc

SEQ ID NO: 19544 - DNA, 24 bp, Homo sapiens
tctccatctcctgacctcgtgatt

SEQ ID NO: 19545 - DNA, 24 bp, Homo sapiens
agttctcttgcctcagcctcctgg

SEQ ID NO: 19546 - DNA, 24 bp, Homo sapiens
gtgaaccgctactttgagaaccct

SEQ ID NO: 19547 - DNA, 24 bp, Homo sapiens
cggagcgtgaggacagtgagactc

SEQ ID NO: 19548 - DNA, 24 bp, Homo sapiens
tgttgttgctgagtttgtgccctt

SEQ ID NO: 19549 - DNA, 24 bp, Homo sapiens
ggacaacaagcacgcactctacca

SEQ ID NO: 19550 - DNA, 24 bp, Homo sapiens
tactaccggaggcaggcgtgggaa

SEQ ID NO: 19551 - DNA, 24 bp, Homo sapiens
gactgcctgaaaagcgccaacact

SEQ ID NO: 19552 - DNA, 24 bp, Homo sapiens
aggaagatggcggatctggaggag

SEQ ID NO: 19553 - DNA, 24 bp, Homo sapiens
tctggaggagcagttgtctgatga

SEQ ID NO: 19554 - DNA, 24 bp, Homo sapiens
ggtttactcaggattcactccttc

SEQ ID NO: 19555 - DNA, 24 bp, Homo sapiens
tggtttactcaggattcactcctt

SEQ ID NO: 19556 - DNA, 24 bp, Homo sapiens
ttggtttactcaggattcactcct

SEQ ID NO: 19557 - DNA, 24 bp, Homo sapiens
tggattgcaaggatatgacatgtc

SEQ ID NO: 19558 - DNA, 24 bp, Homo sapiens
gtggattgcaaggatatgacatgt

SEQ ID NO: 19559 - DNA, 24 bp, Homo sapiens
agtggattgcaaggatatgacatg

SEQ ID NO: 19560 - DNA, 24 bp, Homo sapiens
aagttgcagaggtaaactgtcttt

SEQ ID NO: 19561 - DNA, 24 bp, Homo sapiens
aaagttgcagaggtaaactgtctt

SEQ ID NO: 19562 - DNA, 24 bp, Homo sapiens
caaagttgcagaggtaaactgtct

SEQ ID NO: 19563 - DNA, 24 bp, Homo sapiens
acctttcacaggcccctagcagtc

SEQ ID NO: 19564 - DNA, 24 bp, Homo sapiens
gacctttcacaggcccctagcagt

SEQ ID NO: 19565 - DNA, 24 bp, Homo sapiens
agacctttcacaggcccctagcag

SEQ ID NO: 19566 - DNA, 25 bp, Homo sapiens
tgggtggtggtcttcaaatctctca

SEQ ID NO: 19567 - DNA, 25 bp, Homo sapiens
cacagttggcagacagtttatttga

SEQ ID NO: 19568 - DNA, 25 bp, Homo sapiens
aagcacctggactacttaattcagt

SEQ ID NO: 19569 - DNA, 25 bp, Homo sapiens
ggcagcattagaggaagaacaggca

SEQ ID NO: 19570 - DNA, 23 bp, Homo sapiens
gtgtcttccctggcaagcactgg

SEQ ID NO: 19571 - DNA, 24 bp, Homo sapiens
tctgaccaaagtggatgaaaggga

SEQ ID NO: 19572 - DNA, 24 bp, Homo sapiens
gccctgtccttagcactctattcc

SEQ ID NO: 19573 - DNA, 24 bp, Homo sapiens
gtgcctggactggaccaacctcaa

SEQ ID NO: 19574 - DNA, 24 bp, Homo sapiens
gactctccactgtccgactcaccc

SEQ ID NO: 19575 - DNA, 24 bp, Homo sapiens
gactctccactgtccgactcaccc

SEQ ID NO: 19576 - DNA, 24 bp, Homo sapiens
gcagtcagccttcctggagcactc

SEQ ID NO: 19577 - DNA, 24 bp, Homo sapiens
agcactgagcccgccttggacttc

SEQ ID NO: 19578 - DNA, 24 bp, Homo sapiens
agaagaccgagagccaccacaagg

SEQ ID NO: 19579 - DNA, 24 bp, Homo sapiens
ctggagtacctgaccgccgagatc

SEQ ID NO: 19580 - DNA, 24 bp, Homo sapiens
acaagaagactcgcatcatcccgc

SEQ ID NO: 19581 - DNA, 24 bp, Homo sapiens
gtacctgactgccgagatcctgga

SEQ ID NO: 19582 - DNA, 24 bp, Homo sapiens
gaagaccgagagtcaccacaaggc

SEQ ID NO: 19583 - DNA, 24 bp, Homo sapiens
acaagaagacccgcattatcccgc

SEQ ID NO: 19584 - DNA, 24 bp, Homo sapiens
agtacctgaccgccgagatcctgg

SEQ ID NO: 19585 - DNA, 24 bp, Homo sapiens
ctgctccgtaaaggcaactacgca

SEQ ID NO: 19586 - DNA, 24 bp, Homo sapiens
gcgcgccggtgtacctggcggcgg

SEQ ID NO: 19587 - DNA, 24 bp, Homo sapiens
gaaatcccgctcttctcgcgctgg

SEQ ID NO: 19588 - DNA, 24 bp, Homo sapiens
cgaaatcccgctcttctcgcgctg

SEQ ID NO: 19589 - DNA, 24 bp, Homo sapiens
gcgaaatcccgctcttctcgcgct

SEQ ID NO: 19590 - DNA, 24 bp, Homo sapiens
ctcaacaaactgctaggccgggtg

SEQ ID NO: 19591 - DNA, 24 bp, Homo sapiens
ggcggcgtccttcctaacatccag

SEQ ID NO: 19592 - DNA, 24 bp, Homo sapiens
tctgcctaagaagaccgagagtca

SEQ ID NO: 19593 - DNA, 24 bp, Homo sapiens
gaagaccgagagtcaccacaaggc

SEQ ID NO: 19594 - DNA, 24 bp, Homo sapiens
ggcggcgtccttcctaacatccag

SEQ ID NO: 19595 - DNA, 24 bp, Homo sapiens
acaacaagaagactcgcatcatcc

SEQ ID NO: 19596 - DNA, 24 bp, Homo sapiens
tgatttgacaggtatctgagctcc

SEQ ID NO: 19597 - DNA, 24 bp, Homo sapiens
gtgatttgacaggtatctgagctc

SEQ ID NO: 19598 - DNA, 24 bp, Homo sapiens
agtgatttgacaggtatctgagct

SEQ ID NO: 19599 - DNA, 24 bp, Homo sapiens
ggaaacgctatcaaacccaaaggc

SEQ ID NO: 19600 - DNA, 24 bp, Homo sapiens
gaagaccgagagtcaccacaaggc

SEQ ID NO: 19601 - DNA, 24 bp, Homo sapiens
ggcggcgtccttcctaacatccag

SEQ ID NO: 19602 - DNA, 24 bp, Homo sapiens
aggaataagtggatggatggcatt

SEQ ID NO: 19603 - DNA, 24 bp, Homo sapiens
ttcttgtcaggtagcagactgtgt

SEQ ID NO: 19604 - DNA, 24 bp, Homo sapiens
agaatccatccctcaacttaccca

SEQ ID NO: 19605 - DNA, 24 bp, Homo sapiens
aggaataagtggatggatggcatt

SEQ ID NO: 19606 - DNA, 24 bp, Homo sapiens
agaatccatccctcaacttaccca

SEQ ID NO: 19607 - DNA, 24 bp, Homo sapiens
tctgcccagtattcattcctgctg

SEQ ID NO: 19608 - DNA, 24 bp, Homo sapiens
agccatggccgacaaggtcctgaa

SEQ ID NO: 19609 - DNA, 24 bp, Homo sapiens
aagccatggccgacaaggtcctga

SEQ ID NO: 19610 - DNA, 24 bp, Homo sapiens
aaagccatggccgacaaggtcctg

SEQ ID NO: 19611 - DNA, 24 bp, Homo sapiens
agccatggccgacaagggtgctga

SEQ ID NO: 19612 - DNA, 24 bp, Homo sapiens
aagccatggccgacaagggtgctg

SEQ ID NO: 19613 - DNA, 24 bp, Homo sapiens
aaagccatggccgacaagggtgct

SEQ ID NO: 19614 - DNA, 24 bp, Homo sapiens
gctcccgcgaaatcaagtcccagc

SEQ ID NO: 19615 - DNA, 24 bp, Homo sapiens
ggctcccgcgaaatcaagtcccag

SEQ ID NO: 19616 - DNA, 24 bp, Homo sapiens
cggctcccgcgaaatcaagtccca

SEQ ID NO: 19617 - DNA, 23 bp, Homo sapiens
cctgagggatgagatgcgagcct

SEQ ID NO: 19618 - DNA, 25 bp, Homo sapiens
ccaataccagctagtggacatctcc

SEQ ID NO: 19619 - DNA, 23 bp, Homo sapiens
atcaagtcccagcagagcgaggt

SEQ ID NO: 19620 - DNA, 23 bp, Homo sapiens
cctgagggatgagatgcgagcct

SEQ ID NO: 19621 - DNA, 23 bp, Homo sapiens
gaggtgacccgaatcctggatgg

SEQ ID NO: 19622 - DNA, 25 bp, Homo sapiens
ccaataccagctagtggacatctcc

SEQ ID NO: 19623 - DNA, 23 bp, Homo sapiens
ggctggtcttgaactcctgaact

SEQ ID NO: 19624 - DNA, 23 bp, Homo sapiens
gtccttccacctcggcctcccaa

SEQ ID NO: 19625 - DNA, 24 bp, Homo sapiens
tatatctgaagacggagagcctgt

SEQ ID NO: 19626 - DNA, 24 bp, Homo sapiens
ttatatctgaagacggagagcctg

SEQ ID NO: 19627 - DNA, 24 bp, Homo sapiens
tttatatctgaagacggagagcct

SEQ ID NO: 19628 - DNA, 24 bp, Homo sapiens
ttttattttagaaaagccagtgaa

SEQ ID NO: 19629 - DNA, 24 bp, Homo sapiens
gttttattttagaaaagccagtga

SEQ ID NO: 19630 - DNA, 24 bp, Homo sapiens
ggttttattttagaaaagccagtg

SEQ ID NO: 19631 - DNA, 25 bp, Homo sapiens
ggcatcctccttatcgttctcctga

SEQ ID NO: 19632 - DNA, 25 bp, Homo sapiens
tggaataaacctggcgtcagcattt

SEQ ID NO: 19633 - DNA, 23 bp, Homo sapiens
atgggcacctgggcattcttagc

SEQ ID NO: 19634 - DNA, 25 bp, Homo sapiens
tggaataaacctggcgtcagcattt

SEQ ID NO: 19635 - DNA, 23 bp, Homo sapiens
atgggcacctgggcattcttagc

SEQ ID NO: 19636 - DNA, 24 bp, Homo sapiens
tgcctgctctgccaagacaagaac

SEQ ID NO: 19637 - DNA, 25 bp, Homo sapiens
attgagcccacccaaattctccagg

SEQ ID NO: 19638 - DNA, 23 bp, Homo sapiens
cctctgcatttcaggactcttgc

SEQ ID NO: 19639 - DNA, 23 bp, Homo sapiens
ccacagtcacatcttcctttgac

SEQ ID NO: 19640 - DNA, 25 bp, Homo sapiens
actgtggtgttgtcattgcctgagc

SEQ ID NO: 19641 - DNA, 24 bp, Homo sapiens
gccagacagactgctgagcgacta

SEQ ID NO: 19642 - DNA, 25 bp, Homo sapiens
ggacacttgactcaggagcacgatg

SEQ ID NO: 19643 - DNA, 23 bp, Homo sapiens
gagcccacccaaattctccaggg

SEQ ID NO: 19644 - DNA, 24 bp, Homo sapiens
caaccctacagcctacccgttcca

SEQ ID NO: 19645 - DNA, 24 bp, Homo sapiens
tcaaccctacagcctacccgttcc

SEQ ID NO: 19646 - DNA, 24 bp, Homo sapiens
ctcaaccctacagcctacccgttc

SEQ ID NO: 19647 - DNA, 23 bp, Homo sapiens
acctcgtgatccgcctgccttgg

SEQ ID NO: 19648 - DNA, 23 bp, Homo sapiens
gtgttagccaggatggtctcgat

SEQ ID NO: 19649 - DNA, 23 bp, Homo sapiens
cctgccacctccaagcgatgaag

SEQ ID NO: 19650 - DNA, 24 bp, Homo sapiens
gccaactccagcattctcgtgtga

SEQ ID NO: 19651 - DNA, 25 bp, Homo sapiens
tgtctctgccttcccttcttcccat

SEQ ID NO: 19652 - DNA, 24 bp, Homo sapiens
gacaccttgcgatccaaaatacgg

SEQ ID NO: 19653 - DNA, 24 bp, Homo sapiens
cgacaccttgcgatccaaaatacg

SEQ ID NO: 19654 - DNA, 24 bp, Homo sapiens
tcgacaccttgcgatccaaaatac

SEQ ID NO: 19655 - DNA, 24 bp, Homo sapiens
aggttctaaaggtggagaagatag

SEQ ID NO: 19656 - DNA, 24 bp, Homo sapiens
caggttctaaaggtggagaagata

SEQ ID NO: 19657 - DNA, 24 bp, Homo sapiens
gcaggttctaaaggtggagaagat

SEQ ID NO: 19658 - DNA, 25 bp, Homo sapiens
gctgtgtgaagtcctccagaataag

SEQ ID NO: 19659 - DNA, 23 bp, Homo sapiens
ccagttcaggaaggcaacagcaa

SEQ ID NO: 19660 - DNA, 25 bp, Homo sapiens
atgctgttgatgctgtggtgaatgc

SEQ ID NO: 19661 - DNA, 24 bp, Homo sapiens
aataccagcacaacgagtctcact

SEQ ID NO: 19662 - DNA, 23 bp, Homo sapiens
gctgctgttcctggtctgcggat

SEQ ID NO: 19663 - DNA, 23 bp, Homo sapiens
ctgcgtcctgggtggtgtcatcc

SEQ ID NO: 19664 - DNA, 23 bp, Homo sapiens
ggagtcatcagcaacgagagtgg

SEQ ID NO: 19665 - DNA, 25 bp, Homo sapiens
gctcgctcaggaatggagttcagtc

SEQ ID NO: 19666 - DNA, 24 bp, Homo sapiens
gtggacgtgatgcccgtggataaa

SEQ ID NO: 19667 - DNA, 24 bp, Homo sapiens
aaatctgccctagacaatggacct

SEQ ID NO: 19668 - DNA, 24 bp, Homo sapiens
aaaatctgccctagacaatggacc

SEQ ID NO: 19669 - DNA, 24 bp, Homo sapiens
gaaaatctgccctagacaatggac

SEQ ID NO: 19670 - DNA, 25 bp, Homo sapiens
aagtgattctcctatctcagcctcc

SEQ ID NO: 19671 - DNA, 23 bp, Homo sapiens
ccaggctggagtgcaatagtgcg

SEQ ID NO: 19672 - DNA, 23 bp, Homo sapiens
gctcactgcaacctctgcctccc

SEQ ID NO: 19673 - DNA, 23 bp, Homo sapiens
cctcttggtccattgccacctgg

SEQ ID NO: 19674 - DNA, 25 bp, Homo sapiens
agagaacagacagcaatggcagagt

SEQ ID NO: 19675 - DNA, 25 bp, Homo sapiens
ggaccacaatagaagaactaccacc

SEQ ID NO: 19676 - DNA, 25 bp, Homo sapiens
gtgttgaacccaatgtattgcctgt

SEQ ID NO: 19677 - DNA, 25 bp, Homo sapiens
ccgcttcttacatcaatccagatca

SEQ ID NO: 19678 - DNA, 25 bp, Homo sapiens
atgggaaattcatagacacgggttt

SEQ ID NO: 19679 - DNA, 24 bp, Homo sapiens
cgtcaccccaggtcctgccgccac

SEQ ID NO: 19680 - DNA, 24 bp, Homo sapiens
ccgtcaccccaggtcctgccgcca

SEQ ID NO: 19681 - DNA, 24 bp, Homo sapiens
tccgtcaccccaggtcctgccgcc

SEQ ID NO: 19682 - DNA, 23 bp, Homo sapiens
ctcacagcaacctctgcctcctg

SEQ ID NO: 19683 - DNA, 25 bp, Homo sapiens
aaccattatcatgcctcaggctcca

SEQ ID NO: 19684 - DNA, 25 bp, Homo sapiens
tctgactcgtggatgtgatggacct

SEQ ID NO: 19685 - DNA, 25 bp, Homo sapiens
acactgctctaccaagtctgctatg

SEQ ID NO: 19686 - DNA, 24 bp, Homo sapiens
tcagccaagggactcagaagactc

SEQ ID NO: 19687 - DNA, 24 bp, Homo sapiens
ctgtagtcccagctactcgggagg

SEQ ID NO: 19688 - DNA, 24 bp, Homo sapiens
cctgtagtcccagctactcgggag

SEQ ID NO: 19689 - DNA, 24 bp, Homo sapiens
gcctgtagtcccagctactcggga

SEQ ID NO: 19690 - DNA, 24 bp, Homo sapiens
cttgtcctcagcatctggaatcaa

SEQ ID NO: 19691 - DNA, 24 bp, Homo sapiens
ccttgtcctcagcatctggaatca

SEQ ID NO: 19692 - DNA, 24 bp, Homo sapiens
accttgtcctcagcatctggaatc

SEQ ID NO: 19693 - DNA, 24 bp, Homo sapiens
gatactacatgaacctcaaccaga

SEQ ID NO: 19694 - DNA, 24 bp, Homo sapiens
ggatactacatgaacctcaaccag

SEQ ID NO: 19695 - DNA, 24 bp, Homo sapiens
aggatactacatgaacctcaacca

SEQ ID NO: 19696 - DNA, 24 bp, Homo sapiens
tgctgcctaaattctatggactgt

SEQ ID NO: 19697 - DNA, 24 bp, Homo sapiens
gcaggcaggtggcaagaacattcg

SEQ ID NO: 19698 - DNA, 24 bp, Homo sapiens
ggtgatgaacaatcttttaccaag

SEQ ID NO: 19699 - DNA, 24 bp, Homo sapiens
aaccagagcgtgatgtcctcatgc

SEQ ID NO: 19700 - DNA, 24 bp, Homo sapiens
cacctgttgccttccgctacttcc

SEQ ID NO: 19701 - DNA, 24 bp, Homo sapiens
agtgagccgctgattgaactctgt

SEQ ID NO: 19702 - DNA, 24 bp, Homo sapiens
atgtgtccagcgacgatgagttca

SEQ ID NO: 19703 - DNA, 24 bp, Homo sapiens
agaaccctcggactttgctgccta

SEQ ID NO: 19704 - DNA, 24 bp, Homo sapiens
ggcaggtggcaagaacattcggat

SEQ ID NO: 19705 - DNA, 24 bp, Homo sapiens
ggcaggtggcaagaacattcggat

SEQ ID NO: 19706 - DNA, 24 bp, Homo sapiens
tcccagaaagagcgagagaagcct

SEQ ID NO: 19707 - DNA, 24 bp, Homo sapiens
tgctgcctaaattctatggactgt

SEQ ID NO: 19708 - DNA, 24 bp, Homo sapiens
gggaggccgagggtcaggccaaca

SEQ ID NO: 19709 - DNA, 24 bp, Homo sapiens
tgggaggccgagggtcaggccaac

SEQ ID NO: 19710 - DNA, 24 bp, Homo sapiens
ttgggaggccgagggtcaggccaa

SEQ ID NO: 19711 - DNA, 23 bp, Homo sapiens
cccaacggctaccccatccactc

SEQ ID NO: 19712 - DNA, 23 bp, Homo sapiens
ctgctgctgtgcaatgctcggtg

SEQ ID NO: 19713 - DNA, 23 bp, Homo sapiens
agctggggaagcaggagatggtc

SEQ ID NO: 19714 - DNA, 24 bp, Homo sapiens
ccacctcccaggttcaagcaatac

SEQ ID NO: 19715 - DNA, 24 bp, Homo sapiens
tccacctcccaggttcaagcaata

SEQ ID NO: 19716 - DNA, 24 bp, Homo sapiens
ctccacctcccaggttcaagcaat

SEQ ID NO: 19717 - DNA, 24 bp, Homo sapiens
ctcctgcccagctctgtgatccag

SEQ ID NO: 19718 - DNA, 24 bp, Homo sapiens
cctcctgcccagctctgtgatcca

SEQ ID NO: 19719 - DNA, 24 bp, Homo sapiens
ccctcctgcccagctctgtgatcc

SEQ ID NO: 19720 - DNA, 24 bp, Homo sapiens
gttcagcctgtcctgtcacctctg

SEQ ID NO: 19721 - DNA, 24 bp, Homo sapiens
agcagtgacattcccagagagccc

SEQ ID NO: 19722 - DNA, 24 bp, Homo sapiens
tctcaggcaggcatgactggctac

SEQ ID NO: 19723 - DNA, 24 bp, Homo sapiens
atcgggttacagatgggcaccaac

SEQ ID NO: 19724 - DNA, 24 bp, Homo sapiens
tctcaggcaggcatgactggctac

SEQ ID NO: 19725 - DNA, 24 bp, Homo sapiens
cctgccctcccacgaatggttaat

SEQ ID NO: 19726 - DNA, 24 bp, Homo sapiens
tgcactggaagcatgtttggatgt

SEQ ID NO: 19727 - DNA, 24 bp, Homo sapiens
ctgcactggaagcatgtttggatg

SEQ ID NO: 19728 - DNA, 24 bp, Homo sapiens
gctgcactggaagcatgtttggat

SEQ ID NO: 19729 - DNA, 23 bp, Homo sapiens
ccgaagcacgcctctcacctcag

SEQ ID NO: 19730 - DNA, 23 bp, Homo sapiens
gacagagtctcactgcgttgcct

SEQ ID NO: 19731 - DNA, 25 bp, Homo sapiens
acctggctgtgaacttagtatgtgt

SEQ ID NO: 19732 - DNA, 24 bp, Homo sapiens
aggaaggtggctgaacaggaggag

SEQ ID NO: 19733 - DNA, 25 bp, Homo sapiens
aagtcctctgagcagcctgttacct

SEQ ID NO: 19734 - DNA, 25 bp, Homo sapiens
gcacaatgactccgacatcctcttc

SEQ ID NO: 19735 - DNA, 24 bp, Homo sapiens
tggaccagcaggagttcggagccc

SEQ ID NO: 19736 - DNA, 24 bp, Homo sapiens
ttggaccagcaggagttcggagcc

SEQ ID NO: 19737 - DNA, 24 bp, Homo sapiens
tttggaccagcaggagttcggagc

SEQ ID NO: 19738 - DNA, 24 bp, Homo sapiens
agtacaccacaatccagctgtcct

SEQ ID NO: 19739 - DNA, 24 bp, Homo sapiens
ggattggcatggtgaaccgcacac

SEQ ID NO: 19740 - DNA, 24 bp, Homo sapiens
tgagaatgaacaagacaacagcag

SEQ ID NO: 19741 - DNA, 24 bp, Homo sapiens
tggtggactaacaatggaatcaga

SEQ ID NO: 19742 - DNA, 24 bp, Homo sapiens
gccaagtcagtcagcctccttcac

SEQ ID NO: 19743 - DNA, 24 bp, Homo sapiens
tcaccagggacagtaggacagagc

SEQ ID NO: 19744 - DNA, 24 bp, Homo sapiens
gcctcagtcacctaatgtgttcaa

SEQ ID NO: 19745 - DNA, 24 bp, Homo sapiens
tctggtgccaggtgatctttgacg

SEQ ID NO: 19746 - DNA, 24 bp, Homo sapiens
ttctggtgccaggtgatctttgac

SEQ ID NO: 19747 - DNA, 24 bp, Homo sapiens
attctggtgccaggtgatctttga

SEQ ID NO: 19748 - DNA, 25 bp, Homo sapiens
gaccatgtgtgtctgatctgctggg

SEQ ID NO: 19749 - DNA, 23 bp, Homo sapiens
gcggcggcggcggcggcacagag

SEQ ID NO: 19750 - DNA, 23 bp, Homo sapiens
ctcagggagctgtcaccgtggtc

SEQ ID NO: 19751 - DNA, 24 bp, Homo sapiens
gccaccttcgtagccaatgacctc

SEQ ID NO: 19752 - DNA, 24 bp, Homo sapiens
agaagtgcctggactcctacctgc

SEQ ID NO: 19753 - DNA, 23 bp, Homo sapiens
atcctggacctctgcgtgctctt

SEQ ID NO: 19754 - DNA, 23 bp, Homo sapiens
gccactgcagccaggcgagagcc

SEQ ID NO: 19755 - DNA, 24 bp, Homo sapiens
ccctaaagacaacattcccgccct

SEQ ID NO: 19756 - DNA, 23 bp, Homo sapiens
caatgacctcgactggctcctgg

SEQ ID NO: 19757 - DNA, 23 bp, Homo sapiens
gagtacctggaacgcgccacctt

SEQ ID NO: 19758 - DNA, 24 bp, Homo sapiens
cactggacagcaagacaggagacc

SEQ ID NO: 19759 - DNA, 24 bp, Homo sapiens
catgtgtgtctgatctgctgggat

SEQ ID NO: 19760 - DNA, 25 bp, Homo sapiens
gctggaacaggccaagtgatattgt

SEQ ID NO: 19761 - DNA, 24 bp, Homo sapiens
gagccgccgaggtgatctttgacg

SEQ ID NO: 19762 - DNA, 24 bp, Homo sapiens
ggagccgccgaggtgatctttgac

SEQ ID NO: 19763 - DNA, 24 bp, Homo sapiens
tggagccgccgaggtgatctttga

SEQ ID NO: 19764 - DNA, 25 bp, Homo sapiens
acctcgtgtatgcagagaccatgtg

SEQ ID NO: 19765 - DNA, 23 bp, Homo sapiens
ttctcaccttcctccgcatgtcc

SEQ ID NO: 19766 - DNA, 24 bp, Homo sapiens
agaagtgcctggactcctacctgc

SEQ ID NO: 19767 - DNA, 25 bp, Homo sapiens
gccttgcctcacgataaattctggt

SEQ ID NO: 19768 - DNA, 23 bp, Homo sapiens
atcctggacctctgcgtgctctt

SEQ ID NO: 19769 - DNA, 23 bp, Homo sapiens
tcaccttcctccgcatgtccact

SEQ ID NO: 19770 - DNA, 24 bp, Homo sapiens
agaagtgcctggactcctacctgc

SEQ ID NO: 19771 - DNA, 24 bp, Homo sapiens
tcccgccctagtggaggagtacct

SEQ ID NO: 19772 - DNA, 24 bp, Homo sapiens
ttcccgccctagtggaggagtacc

SEQ ID NO: 19773 - DNA, 24 bp, Homo sapiens
attcccgccctagtggaggagtac

SEQ ID NO: 19774 - DNA, 25 bp, Homo sapiens
tggaacaggtgtcaaggactaggca

SEQ ID NO: 19775 - DNA, 24 bp, Homo sapiens
catgtgtgtctgatctgctgggat

SEQ ID NO: 19776 - DNA, 25 bp, Homo sapiens
acagcaagacaggagaccttggatc

SEQ ID NO: 19777 - DNA, 23 bp, Homo sapiens
gccaagtgatattgtgaaaagaa

SEQ ID NO: 19778 - DNA, 25 bp, Homo sapiens
agccaagttactacagtgacctgga

SEQ ID NO: 19779 - DNA, 25 bp, Homo sapiens
agagatggtgctgtggtcgtaatgc

SEQ ID NO: 19780 - DNA, 25 bp, Homo sapiens
gttgttgctaccacctcttatctga

SEQ ID NO: 19781 - DNA, 25 bp, Homo sapiens
tggaggattgtttgatggtgggtct

SEQ ID NO: 19782 - DNA, 24 bp, Homo sapiens
cgggagcggaggctgctgcggagg

SEQ ID NO: 19783 - DNA, 24 bp, Homo sapiens
gcgggagcggaggctgctgcggag

SEQ ID NO: 19784 - DNA, 24 bp, Homo sapiens
agcgggagcggaggctgctgcgga

SEQ ID NO: 19785 - DNA, 24 bp, Homo sapiens
cggaagtgctgggattacaggcgt

SEQ ID NO: 19786 - DNA, 24 bp, Homo sapiens
ccggaagtgctgggattacaggcg

SEQ ID NO: 19787 - DNA, 24 bp, Homo sapiens
tccggaagtgctgggattacaggc

SEQ ID NO: 19788 - DNA, 24 bp, Homo sapiens
tcaaatcctgactcggcctcccag

SEQ ID NO: 19789 - DNA, 24 bp, Homo sapiens
ttcaaatcctgactcggcctccca

SEQ ID NO: 19790 - DNA, 24 bp, Homo sapiens
attcaaatcctgactcggcctccc

SEQ ID NO: 19791 - DNA, 24 bp, Homo sapiens
aaatgatccccctgcctcggcctc

SEQ ID NO: 19792 - DNA, 24 bp, Homo sapiens
caaatgatccccctgcctcggcct

SEQ ID NO: 19793 - DNA, 24 bp, Homo sapiens
tcaaatgatccccctgcctcggcc

SEQ ID NO: 19794 - DNA, 24 bp, Homo sapiens
ttaggaggagccgctgcatccgag

SEQ ID NO: 19795 - DNA, 24 bp, Homo sapiens
gacagtttagggtggtctcatgga

SEQ ID NO: 19796 - DNA, 24 bp, Homo sapiens
ggacagtttagggtggtctcatgg

SEQ ID NO: 19797 - DNA, 24 bp, Homo sapiens
tggacagtttagggtggtctcatg

SEQ ID NO: 19798 - DNA, 24 bp, Homo sapiens
ataagaactgggattgcaggcgtg

SEQ ID NO: 19799 - DNA, 24 bp, Homo sapiens
cataagaactgggattgcaggcgt

SEQ ID NO: 19800 - DNA, 24 bp, Homo sapiens
gcataagaactgggattgcaggcg

SEQ ID NO: 19801 - DNA, 25 bp, Homo sapiens
tggaattataggcgtgagccactgc

SEQ ID NO: 19802 - DNA, 25 bp, Homo sapiens
tggatgctagttctcatgcctcagg

SEQ ID NO: 19803 - DNA, 25 bp, Homo sapiens
agccagtcttcactagccacgaatg

SEQ ID NO: 19804 - DNA, 25 bp, Homo sapiens
caagccaacaacagtgacggaatgc

SEQ ID NO: 19805 - DNA, 24 bp, Homo sapiens
aaataaagcagccagcgcacatcc

SEQ ID NO: 19806 - DNA, 24 bp, Homo sapiens
taaataaagcagccagcgcacatc

SEQ ID NO: 19807 - DNA, 24 bp, Homo sapiens
ttaaataaagcagccagcgcacat

SEQ ID NO: 19808 - DNA, 24 bp, Homo sapiens
ggtgtgagtgagtgtgggtgtgtg

SEQ ID NO: 19809 - DNA, 24 bp, Homo sapiens
tgaactgatctcacttggctccga

SEQ ID NO: 19810 - DNA, 24 bp, Homo sapiens
cctgacatcctggacaagggaagc

SEQ ID NO: 19811 - DNA, 24 bp, Homo sapiens
aatgacctcaccaagctctccaag

SEQ ID NO: 19812 - DNA, 24 bp, Homo sapiens
gaatgacctcaccaagctctccaa

SEQ ID NO: 19813 - DNA, 24 bp, Homo sapiens
agaatgacctcaccaagctctcca

SEQ ID NO: 19814 - DNA, 24 bp, Homo sapiens
aagaaaaggacaggctgagaacag

SEQ ID NO: 19815 - DNA, 24 bp, Homo sapiens
aaagaaaaggacaggctgagaaca

SEQ ID NO: 19816 - DNA, 24 bp, Homo sapiens
aaaagaaaaggacaggctgagaac

SEQ ID NO: 19817 - DNA, 25 bp, Homo sapiens
cctgtctctgctggaaatgatgcct

SEQ ID NO: 19818 - DNA, 25 bp, Homo sapiens
gtagtttgttggcagagaatcaggt

SEQ ID NO: 19819 - DNA, 25 bp, Homo sapiens
cctaacagtccagcaggaagaaggc

SEQ ID NO: 19820 - DNA, 24 bp, Homo sapiens
ggctggagtgcagtggcatgatcc

SEQ ID NO: 19821 - DNA, 24 bp, Homo sapiens
attgcaacctccgcctccctgatt

SEQ ID NO: 19822 - DNA, 24 bp, Homo sapiens
tttttccacctcagcttctcatgt

SEQ ID NO: 19823 - DNA, 24 bp, Homo sapiens
gcctcctacaggcaccttctcact

SEQ ID NO: 19824 - DNA, 24 bp, Homo sapiens
agcctcctacaggcaccttctcac

SEQ ID NO: 19825 - DNA, 24 bp, Homo sapiens
aagcctcctacaggcaccttctca

SEQ ID NO: 19826 - DNA, 23 bp, Homo sapiens
acccaggcaagaagttcccacat

SEQ ID NO: 19827 - DNA, 24 bp, Homo sapiens
tgaatccaggcgagaagttcccat

SEQ ID NO: 19828 - DNA, 25 bp, Homo sapiens
agactctgaacccaggcaagaagtt

SEQ ID NO: 19829 - DNA, 24 bp, Homo sapiens
ccaggcaagaagttcccatgtata

SEQ ID NO: 19830 - DNA, 24 bp, Homo sapiens
cccaggcaagaagttcccatgtat

SEQ ID NO: 19831 - DNA, 24 bp, Homo sapiens
acccaggcaagaagttcccatgta

SEQ ID NO: 19832 - DNA, 24 bp, Homo sapiens
ccaggcgagaagttcccatgtata

SEQ ID NO: 19833 - DNA, 24 bp, Homo sapiens
tccaggcgagaagttcccatgtat

SEQ ID NO: 19834 - DNA, 24 bp, Homo sapiens
atccaggcgagaagttcccatgta

SEQ ID NO: 19835 - DNA, 25 bp, Homo sapiens
acccaggcaagaagttcccatgtat

SEQ ID NO: 19836 - DNA, 24 bp, Homo sapiens
tgaatccaggcaagaagttcccat

SEQ ID NO: 19837 - DNA, 25 bp, Homo sapiens
atccaagcaagaagactccatgtgt

SEQ ID NO: 19838 - DNA, 25 bp, Homo sapiens
atccaagcaagaagactccatgtgt

SEQ ID NO: 19839 - DNA, 24 bp, Homo sapiens
tgaatccaggcaagaagttcccat

SEQ ID NO: 19840 - DNA, 24 bp, Homo sapiens
caggctctgaacccaggcaagaag

SEQ ID NO: 19841 - DNA, 24 bp, Homo sapiens
acagcagcagcagtagcagcagta

SEQ ID NO: 19842 - DNA, 24 bp, Homo sapiens
tccacctcttcctcctcttccact

SEQ ID NO: 19843 - DNA, 24 bp, Homo sapiens
ccttcaacctcgtccttctgcctg

SEQ ID NO: 19844 - DNA, 24 bp, Homo sapiens
gcccatctcggcttcccaaagtgc

SEQ ID NO: 19845 - DNA, 24 bp, Homo sapiens
tgcccatctcggcttcccaaagtg

SEQ ID NO: 19846 - DNA, 24 bp, Homo sapiens
ttgcccatctcggcttcccaaagt

SEQ ID NO: 19847 - DNA, 24 bp, Homo sapiens
cacgcctcagactcccaaagtgct

SEQ ID NO: 19848 - DNA, 24 bp, Homo sapiens
acacgcctcagactcccaaagtgc

SEQ ID NO: 19849 - DNA, 24 bp, Homo sapiens
cacacgcctcagactcccaaagtg

SEQ ID NO: 19850 - DNA, 24 bp, Homo sapiens
tctgcagaaagggctcgaccactt

SEQ ID NO: 19851 - DNA, 24 bp, Homo sapiens
ttctgcagaaagggctcgaccact

SEQ ID NO: 19852 - DNA, 24 bp, Homo sapiens
attctgcagaaagggctcgaccac

SEQ ID NO: 19853 - DNA, 23 bp, Homo sapiens
gctggaaggcatgttcaaggaca

SEQ ID NO: 19854 - DNA, 25 bp, Homo sapiens
aacatactcacaatgggctactggc

SEQ ID NO: 19855 - DNA, 25 bp, Homo sapiens
tttatcttggaaagcacagtggtcg

SEQ ID NO: 19856 - DNA, 23 bp, Homo sapiens
tgttgctcccacctcagtcttct

SEQ ID NO: 19857 - DNA, 25 bp, Homo sapiens
gatcacggttcactgcagcattgac

SEQ ID NO: 19858 - DNA, 24 bp, Homo sapiens
ctgacctcaagtgatccgcccatc

SEQ ID NO: 19859 - DNA, 24 bp, Homo sapiens
cctgacctcaagtgatccgcccat

SEQ ID NO: 19860 - DNA, 24 bp, Homo sapiens
tcctgacctcaagtgatccgccca

SEQ ID NO: 19861 - DNA, 24 bp, Homo sapiens
taggactacaggtgcgttccacca

SEQ ID NO: 19862 - DNA, 24 bp, Homo sapiens
ctaggactacaggtgcgttccacc

SEQ ID NO: 19863 - DNA, 24 bp, Homo sapiens
gctaggactacaggtgcgttccac

SEQ ID NO: 19864 - DNA, 24 bp, Homo sapiens
cccccggccagtccctgtacgagc

SEQ ID NO: 19865 - DNA, 24 bp, Homo sapiens
gcccccggccagtccctgtacgag

SEQ ID NO: 19866 - DNA, 24 bp, Homo sapiens
cgcccccggccagtccctgtacga

SEQ ID NO: 19867 - DNA, 24 bp, Homo sapiens
ctcacctgaagaaaaaagcagtca

SEQ ID NO: 19868 - DNA, 24 bp, Homo sapiens
cctcacctgaagaaaaaagcagtc

SEQ ID NO: 19869 - DNA, 24 bp, Homo sapiens
ccctcacctgaagaaaaaagcagt

SEQ ID NO: 19870 - DNA, 24 bp, Homo sapiens
tgtgggcaaacattctgaagcgtg

SEQ ID NO: 19871 - DNA, 24 bp, Homo sapiens
atgtgggcaaacattctgaagcgt

SEQ ID NO: 19872 - DNA, 24 bp, Homo sapiens
gatgtgggcaaacattctgaagcg

SEQ ID NO: 19873 - DNA, 24 bp, Homo sapiens
gactatgccaggagagactcttgc

SEQ ID NO: 19874 - DNA, 24 bp, Homo sapiens
tgactatgccaggagagactcttg

SEQ ID NO: 19875 - DNA, 24 bp, Homo sapiens
gtgactatgccaggagagactctt

SEQ ID NO: 19876 - DNA, 24 bp, Homo sapiens
actttgaaaaggctgtcacccttg

SEQ ID NO: 19877 - DNA, 24 bp, Homo sapiens
cactttgaaaaggctgtcaccctt

SEQ ID NO: 19878 - DNA, 24 bp, Homo sapiens
tcactttgaaaaggctgtcaccct

SEQ ID NO: 19879 - DNA, 24 bp, Homo sapiens
atttttgacaggttgctgaagcag

SEQ ID NO: 19880 - DNA, 24 bp, Homo sapiens
catttttgacaggttgctgaagca

SEQ ID NO: 19881 - DNA, 24 bp, Homo sapiens
gcatttttgacaggttgctgaagc

SEQ ID NO: 19882 - DNA, 23 bp, Homo sapiens
gctccagatggcgtcttccgtgg

SEQ ID NO: 19883 - DNA, 23 bp, Homo sapiens
gcggcagcaggaccaattacctc

SEQ ID NO: 19884 - DNA, 25 bp, Homo sapiens
tgctgcccttgtactactacctcca

SEQ ID NO: 19885 - DNA, 24 bp, Homo sapiens
cccctcctaaggcatgttatttga

SEQ ID NO: 19886 - DNA, 24 bp, Homo sapiens
acccctcctaaggcatgttatttg

SEQ ID NO: 19887 - DNA, 24 bp, Homo sapiens
aacccctcctaaggcatgttattt

SEQ ID NO: 19888 - DNA, 25 bp, Homo sapiens
cccttgacccaaactttctggatgc

SEQ ID NO: 19889 - DNA, 25 bp, Homo sapiens
ggaaatgtcttgaaagaggcacgca

SEQ ID NO: 19890 - DNA, 24 bp, Homo sapiens
attgagacgcaaccgaactttgca

SEQ ID NO: 19891 - DNA, 23 bp, Homo sapiens
gcggcagcaggaccaattacctc

SEQ ID NO: 19892 - DNA, 25 bp, Homo sapiens
tgctgcccttgtactactacctcca

SEQ ID NO: 19893 - DNA, 23 bp, Homo sapiens
cgctcaagccctccagagcattg

SEQ ID NO: 19894 - DNA, 24 bp, Homo sapiens
tctccctcgagaagctccagatgg

SEQ ID NO: 19895 - DNA, 24 bp, Homo sapiens
ctctccctcgagaagctccagatg

SEQ ID NO: 19896 - DNA, 24 bp, Homo sapiens
gctctccctcgagaagctccagat

SEQ ID NO: 19897 - DNA, 25 bp, Homo sapiens
tgctgcccttgtactactacctcca

SEQ ID NO: 19898 - DNA, 23 bp, Homo sapiens
gctccagatggcgtcttccgtgg

SEQ ID NO: 19899 - DNA, 23 bp, Homo sapiens
gctccagatggcgtcttccgtgg

SEQ ID NO: 19900 - DNA, 25 bp, Homo sapiens
aatacgttcttgctggtagtggcgg

SEQ ID NO: 19901 - DNA, 23 bp, Homo sapiens
tgtaactgctgccgccgctcaag

SEQ ID NO: 19902 - DNA, 25 bp, Homo sapiens
tgactatgccaggagagactcttgc

SEQ ID NO: 19903 - DNA, 23 bp, Homo sapiens
cagggatggatgtcctctgggca

SEQ ID NO: 19904 - DNA, 23 bp, Homo sapiens
ggacactccactctgtaatgggc

SEQ ID NO: 19905 - DNA, 24 bp, Homo sapiens
gcggctctatctacagatgtggga

SEQ ID NO: 19906 - DNA, 23 bp, Homo sapiens
gctggcaacaaacctgaccacat

SEQ ID NO: 19907 - DNA, 25 bp, Homo sapiens
gtctggaagcaaagaatatctagcc

SEQ ID NO: 19908 - DNA, 25 bp, Homo sapiens
ggaagaagccaaggtaggtgtttga

SEQ ID NO: 19909 - DNA, 25 bp, Homo sapiens
ttgccaagtcttcaactcttcattg

SEQ ID NO: 19910 - DNA, 25 bp, Homo sapiens
gcacgaatcgcctcagaatagagca

SEQ ID NO: 19911 - DNA, 25 bp, Homo sapiens
tcatggcttcaggaaggctattgct

SEQ ID NO: 19912 - DNA, 25 bp, Homo sapiens
tgagcgaatgaagaagttggtcagt

SEQ ID NO: 19913 - DNA, 25 bp, Homo sapiens
tgcttattgtaacttggctcattgc

SEQ ID NO: 19914 - DNA, 25 bp, Homo sapiens
gctcctattcaggcaatgtggctgg

SEQ ID NO: 19915 - DNA, 25 bp, Homo sapiens
ctgagcagtattccgagaaattggc

SEQ ID NO: 19916 - DNA, 25 bp, Homo sapiens
tgctaatatgttccctcacctgaag

SEQ ID NO: 19917 - DNA, 25 bp, Homo sapiens
ttagcaatggactggcaactactca

SEQ ID NO: 19918 - DNA, 25 bp, Homo sapiens
ataaggctgcaactggagaggaggt

SEQ ID NO: 19919 - DNA, 25 bp, Homo sapiens
cagtacgggttaccagaagatgcca

SEQ ID NO: 19920 - DNA, 25 bp, Homo sapiens
cagtacgggttaccagaagatgcca

SEQ ID NO: 19921 - DNA, 23 bp, Homo sapiens
tgtgggcaaacattctgaagcgt

SEQ ID NO: 19922 - DNA, 25 bp, Homo sapiens
aatagtgtactctggctgttgcgtt

SEQ ID NO: 19923 - DNA, 25 bp, Homo sapiens
ttgtcaagatgaagtgtcctgatgg

SEQ ID NO: 19924 - DNA, 25 bp, Homo sapiens
aatcggatagttctgaatggcatcg

SEQ ID NO: 19925 - DNA, 25 bp, Homo sapiens
tgctaatatgttccctcacctgaag

SEQ ID NO: 19926 - DNA, 24 bp, Homo sapiens
gctcacttgcttaggttgtcttga

SEQ ID NO: 19927 - DNA, 24 bp, Homo sapiens
tcgtggcaaagtctggaagcaaag

SEQ ID NO: 19928 - DNA, 25 bp, Homo sapiens
caatacacaatggaactagagcggc

SEQ ID NO: 19929 - DNA, 23 bp, Homo sapiens
tccctgactcgcctccagcagtg

SEQ ID NO: 19930 - DNA, 24 bp, Homo sapiens
tcctggtgttgccacccacctggg

SEQ ID NO: 19931 - DNA, 24 bp, Homo sapiens
ctcctggtgttgccacccacctgg

SEQ ID NO: 19932 - DNA, 24 bp, Homo sapiens
actcctggtgttgccacccacctg

SEQ ID NO: 19933 - DNA, 24 bp, Homo sapiens
tgcttctgttggtattatccaaag

SEQ ID NO: 19934 - DNA, 24 bp, Homo sapiens
ctgcttctgttggtattatccaaa

SEQ ID NO: 19935 - DNA, 24 bp, Homo sapiens
tctgcttctgttggtattatccaa

SEQ ID NO: 19936 - DNA, 23 bp, Homo sapiens
ggaggaaccatacatccagttgc

SEQ ID NO: 19937 - DNA, 25 bp, Homo sapiens
tgaccagagaggaaggagaagatgc

SEQ ID NO: 19938 - DNA, 25 bp, Homo sapiens
gtctgctattgctatacaaggaggc

SEQ ID NO: 19939 - DNA, 23 bp, Homo sapiens
gtgctaggattacaggcgtgaac

SEQ ID NO: 19940 - DNA, 25 bp, Homo sapiens
tcaagtgatcctccttcttcagctt

SEQ ID NO: 19941 - DNA, 23 bp, Homo sapiens
ttgtccaggctggtctgcagctc

SEQ ID NO: 19942 - DNA, 24 bp, Homo sapiens
agtgctgggattacaggcgtgaac

SEQ ID NO: 19943 - DNA, 23 bp, Homo sapiens
tcatgtgatcgcctgcctcggcc

SEQ ID NO: 19944 - DNA, 23 bp, Homo sapiens
ttggccaggctggtcttgaactc

SEQ ID NO: 19945 - DNA, 25 bp, Homo sapiens
tcactgtggcattaggtggatactg

SEQ ID NO: 19946 - DNA, 25 bp, Homo sapiens
actatggtggttatttttgtaattg

SEQ ID NO: 19947 - DNA, 25 bp, Homo sapiens
tgtattctccatcgtggcctaactt

SEQ ID NO: 19948 - DNA, 23 bp, Homo sapiens
tgtcgccaccgcccataaaggag

SEQ ID NO: 19949 - DNA, 25 bp, Homo sapiens
gctcttgctggagttcctcaatgac

SEQ ID NO: 19950 - DNA, 24 bp, Homo sapiens
cctcacaccctgctaccaccctaa

SEQ ID NO: 19951 - DNA, 23 bp, Homo sapiens
gtccaggctggtctcgaactcct

SEQ ID NO: 19952 - DNA, 23 bp, Homo sapiens
gattcgcccaccttggcctccca

SEQ ID NO: 19953 - DNA, 25 bp, Homo sapiens
tttagtagagacagggtttcaccat

SEQ ID NO: 19954 - DNA, 23 bp, Homo sapiens
tgatccacccacctcggcctccc

SEQ ID NO: 19955 - DNA, 23 bp, Homo sapiens
caggctggtcccgaactcctgac

SEQ ID NO: 19956 - DNA, 23 bp, Homo sapiens
cggcagcactctagttccaacat

SEQ ID NO: 19957 - DNA, 23 bp, Homo sapiens
aaccttcaaccacctgacctcat

SEQ ID NO: 19958 - DNA, 25 bp, Homo sapiens
gcactgctggtgtacgacattacaa

SEQ ID NO: 19959 - DNA, 24 bp, Homo sapiens
gataagcggttccagcctgtccac

SEQ ID NO: 19960 - DNA, 25 bp, Homo sapiens
ggtcaacattgatggaaaacaaatc

SEQ ID NO: 19961 - DNA, 23 bp, Homo sapiens
acaataggtgtggagtttggagc

SEQ ID NO: 19962 - DNA, 25 bp, Homo sapiens
tccttccgttctatcacccgttcct

SEQ ID NO: 19963 - DNA, 23 bp, Homo sapiens
aaccttcaaccacctgacctcat

SEQ ID NO: 19964 - DNA, 23 bp, Homo sapiens
cggcagcactctagttccaacat

SEQ ID NO: 19965 - DNA, 23 bp, Homo sapiens
ttacagataagcggttccagcct

SEQ ID NO: 19966 - DNA, 25 bp, Homo sapiens
atcatcatcggagacacaggtgtgg

SEQ ID NO: 19967 - DNA, 25 bp, Homo sapiens
gcgacaccatgacttatgcttatct

SEQ ID NO: 19968 - DNA, 25 bp, Homo sapiens
atgtgaagagagaagaaggagaggc

SEQ ID NO: 19969 - DNA, 25 bp, Homo sapiens
ggagcatggacttatattcatggaa

SEQ ID NO: 19970 - DNA, 24 bp, Homo sapiens
ggttcaagcgattctcctgccaca

SEQ ID NO: 19971 - DNA, 23 bp, Homo sapiens
cacccgcctcagcctcccaaagt

SEQ ID NO: 19972 - DNA, 25 bp, Homo sapiens
gctggtcttgaacctctgatctcag

SEQ ID NO: 19973 - DNA, 24 bp, Homo sapiens
ctacagaacagcctcggcctccgc

SEQ ID NO: 19974 - DNA, 24 bp, Homo sapiens
cctacagaacagcctcggcctccg

SEQ ID NO: 19975 - DNA, 24 bp, Homo sapiens
ccctacagaacagcctcggcctcc

SEQ ID NO: 19976 - DNA, 23 bp, Homo sapiens
cccaaagccaaagtggacccagc

SEQ ID NO: 19977 - DNA, 25 bp, Homo sapiens
tgtccctgacttcatctccaaagaa

SEQ ID NO: 19978 - DNA, 23 bp, Homo sapiens
aaccgttcagagtggagcaggca

SEQ ID NO: 19979 - DNA, 24 bp, Homo sapiens
gattaagattcacaccagagtccg

SEQ ID NO: 19980 - DNA, 23 bp, Homo sapiens
gggtagggtcctgactgctgtga

SEQ ID NO: 19981 - DNA, 25 bp, Homo sapiens
cggctgactaatcactgctttcggc

SEQ ID NO: 19982 - DNA, 24 bp, Homo sapiens
gtcccagactgtccccagcagtgg

SEQ ID NO: 19983 - DNA, 24 bp, Homo sapiens
tgtcccagactgtccccagcagtg

SEQ ID NO: 19984 - DNA, 24 bp, Homo sapiens
ctgtcccagactgtccccagcagt

SEQ ID NO: 19985 - DNA, 25 bp, Homo sapiens
cctgaaggcggagaagattctgaca

SEQ ID NO: 19986 - DNA, 25 bp, Homo sapiens
aaattactgccctcctgtcaagcga

SEQ ID NO: 19987 - DNA, 24 bp, Homo sapiens
ccagttcccaccctcacagtcaga

SEQ ID NO: 19988 - DNA, 23 bp, Homo sapiens
caagccagaagcccaaggagcag

SEQ ID NO: 19989 - DNA, 25 bp, Homo sapiens
atgagtccagcaatgcctctgaaga

SEQ ID NO: 19990 - DNA, 25 bp, Homo sapiens
tttgggcagaacttgagggacagag

SEQ ID NO: 19991 - DNA, 24 bp, Homo sapiens
tggatgaaaaggtgagagagcgat

SEQ ID NO: 19992 - DNA, 24 bp, Homo sapiens
ctggatgaaaaggtgagagagcga

SEQ ID NO: 19993 - DNA, 24 bp, Homo sapiens
tctggatgaaaaggtgagagagcg

SEQ ID NO: 19994 - DNA, 23 bp, Homo sapiens
ttaagccacgaggaagaccttgc

SEQ ID NO: 19995 - DNA, 25 bp, Homo sapiens
aagcagtcaagggaacagagccaaa

SEQ ID NO: 19996 - DNA, 25 bp, Homo sapiens
ctggaagaggatctggacacggcta

SEQ ID NO: 19997 - DNA, 24 bp, Homo sapiens
atcctgcccagaggattgctgctg

SEQ ID NO: 19998 - DNA, 24 bp, Homo sapiens
catcctgcccagaggattgctgct

SEQ ID NO: 19999 - DNA, 24 bp, Homo sapiens
ccatcctgcccagaggattgctgc

SEQ ID NO: 20000 - DNA, 24 bp, Homo sapiens
ggatatgtgcccgtgtggatgctt

SEQ ID NO: 20001 - DNA, 24 bp, Homo sapiens
tgttgtcattgtcttggatggctc

SEQ ID NO: 20002 - DNA, 24 bp, Homo sapiens
aaggaagaagtggtgagagcagca

SEQ ID NO: 20003 - DNA, 25 bp, Homo sapiens
gtggagaagaaactggcagagtaca

SEQ ID NO: 20004 - DNA, 25 bp, Homo sapiens
aatggcgggatttggtgctatggag

SEQ ID NO: 20005 - DNA, 25 bp, Homo sapiens
tgacattagaactttctttcctgag

SEQ ID NO: 20006 - DNA, 24 bp, Homo sapiens
ctccccggaatgctggtgagattg

SEQ ID NO: 20007 - DNA, 24 bp, Homo sapiens
cctccccggaatgctggtgagatt

SEQ ID NO: 20008 - DNA, 24 bp, Homo sapiens
ccctccccggaatgctggtgagat

SEQ ID NO: 20009 - DNA, 24 bp, Homo sapiens
cagacgtggctactatggaaggcg

SEQ ID NO: 20010 - DNA, 24 bp, Homo sapiens
ctgtggaagggagtcgttacgctg

SEQ ID NO: 20011 - DNA, 24 bp, Homo sapiens
tgtggttgaaggagagaagggtgc

SEQ ID NO: 20012 - DNA, 24 bp, Homo sapiens
gccacaaccttaaccaacaccaaa

SEQ ID NO: 20013 - DNA, 24 bp, Homo sapiens
gcacggaagacaagagagtagcct

SEQ ID NO: 20014 - DNA, 24 bp, Homo sapiens
tgctggtgctaaacctccaagtgt

SEQ ID NO: 20015 - DNA, 24 bp, Homo sapiens
cagacgtggctactatggaaggcg

SEQ ID NO: 20016 - DNA, 24 bp, Homo sapiens
ctgtggaagggagtcgttacgctg

SEQ ID NO: 20017 - DNA, 24 bp, Homo sapiens
tgcagaagctgccaatgtgactgg

SEQ ID NO: 20018 - DNA, 24 bp, Homo sapiens
ccagagggagcacaacttcaggga

SEQ ID NO: 20019 - DNA, 24 bp, Homo sapiens
gctggtgagattggagagatgaag

SEQ ID NO: 20020 - DNA, 24 bp, Homo sapiens
ctgtggaagggagtcgttacgctg

SEQ ID NO: 20021 - DNA, 24 bp, Homo sapiens
gagcggcagcagtgaaggatttga

SEQ ID NO: 20022 - DNA, 24 bp, Homo sapiens
atacaggctggtgagattggagag

SEQ ID NO: 20023 - DNA, 24 bp, Homo sapiens
cagacgtggctactatggaaggcg

SEQ ID NO: 20024 - DNA, 24 bp, Homo sapiens
tgactggcccggatggagttcctg

SEQ ID NO: 20025 - DNA, 24 bp, Homo sapiens
ggagtcgttacgctgcagatcggc

SEQ ID NO: 20026 - DNA, 24 bp, Homo sapiens
cagccgtctgttcgccgtggatat

SEQ ID NO: 20027 - DNA, 24 bp, Homo sapiens
cgaaatccaacttaccgcccaagg

SEQ ID NO: 20028 - DNA, 24 bp, Homo sapiens
ccagagggagcacaacttcaggga

SEQ ID NO: 20029 - DNA, 24 bp, Homo sapiens
agtccttctgcgtctgcctcccag

SEQ ID NO: 20030 - DNA, 24 bp, Homo sapiens
ggttggtgttgaactcctggcctc

SEQ ID NO: 20031 - DNA, 25 bp, Homo sapiens
tctgtgagcactttcttgctttctg

SEQ ID NO: 20032 - DNA, 24 bp, Homo sapiens
ggttcaagcgattcttctgcctca

SEQ ID NO: 20033 - DNA, 23 bp, Homo sapiens
aactcctgacctcgtgatccgcc

SEQ ID NO: 20034 - DNA, 25 bp, Homo sapiens
agtacagtggcacgatctcggttca

SEQ ID NO: 20035 - DNA, 24 bp, Homo sapiens
gggtgacagagcgagactccatct

SEQ ID NO: 20036 - DNA, 24 bp, Homo sapiens
tgggtgacagagcgagactccatc

SEQ ID NO: 20037 - DNA, 24 bp, Homo sapiens
ctgggtgacagagcgagactccat

SEQ ID NO: 20038 - DNA, 24 bp, Homo sapiens
ccgcctcctggattcaagcaattc

SEQ ID NO: 20039 - DNA, 24 bp, Homo sapiens
agatcatccacctgcctcagcctc

SEQ ID NO: 20040 - DNA, 24 bp, Homo sapiens
ttcagcctcccgagtaggatgcgc

SEQ ID NO: 20041 - DNA, 24 bp, Homo sapiens
tgtgcatttaggtcagatgataca

SEQ ID NO: 20042 - DNA, 24 bp, Homo sapiens
ctgtgcatttaggtcagatgatac

SEQ ID NO: 20043 - DNA, 24 bp, Homo sapiens
cctgtgcatttaggtcagatgata

SEQ ID NO: 20044 - DNA, 24 bp, Homo sapiens
cagcctttcagattaagttcatcc

SEQ ID NO: 20045 - DNA, 24 bp, Homo sapiens
ccagcctttcagattaagttcatc

SEQ ID NO: 20046 - DNA, 24 bp, Homo sapiens
cccagcctttcagattaagttcat

SEQ ID NO: 20047 - DNA, 25 bp, Homo sapiens
acttctttgtcttcgggtgccactg

SEQ ID NO: 20048 - DNA, 25 bp, Homo sapiens
cctcctcatcctctaaggcaggctt

SEQ ID NO: 20049 - DNA, 24 bp, Homo sapiens
caacagaagcagcaacagcaacgg

SEQ ID NO: 20050 - DNA, 23 bp, Homo sapiens
ccgctgaacttggcaatggtgta

SEQ ID NO: 20051 - DNA, 24 bp, Homo sapiens
cgaccatccagtgaaggaagtatt

SEQ ID NO: 20052 - DNA, 23 bp, Homo sapiens
acagccacgtacctcaccatcct

SEQ ID NO: 20053 - DNA, 24 bp, Homo sapiens
agagcagtgtcccagcctttcaga

SEQ ID NO: 20054 - DNA, 24 bp, Homo sapiens
aagtcagagacagccacgtacctc

SEQ ID NO: 20055 - DNA, 24 bp, Homo sapiens
aacccagggagacaaactacgtgc

SEQ ID NO: 20056 - DNA, 24 bp, Homo sapiens
agagcagtgtcccagcctttcaga

SEQ ID NO: 20057 - DNA, 25 bp, Homo sapiens
cctcctcatcctctaaggcaggctt

SEQ ID NO: 20058 - DNA, 24 bp, Homo sapiens
caacagaagcagcaacagcaacgg

SEQ ID NO: 20059 - DNA, 25 bp, Homo sapiens
cctcctcatcctctaaggcaggctt

SEQ ID NO: 20060 - DNA, 24 bp, Homo sapiens
caacagaagcagcaacagcaacgg

SEQ ID NO: 20061 - DNA, 25 bp, Homo sapiens
caagacagaggagcacaccaccatc

SEQ ID NO: 20062 - DNA, 25 bp, Homo sapiens
aaagacttggactggaaatgggtca

SEQ ID NO: 20063 - DNA, 25 bp, Homo sapiens
gcattaaccactcaatgactctggc

SEQ ID NO: 20064 - DNA, 25 bp, Homo sapiens
ggaatcgctggtttggaatgtttgc

SEQ ID NO: 20065 - DNA, 24 bp, Homo sapiens
ggaggctgagacaggagaatcact

SEQ ID NO: 20066 - DNA, 24 bp, Homo sapiens
tttgggaggctgaggcaggtggat

SEQ ID NO: 20067 - DNA, 24 bp, Homo sapiens
gtcaggagttcgagaccagcctgg

SEQ ID NO: 20068 - DNA, 24 bp, Homo sapiens
caacacagcaggctgaacaagctc

SEQ ID NO: 20069 - DNA, 24 bp, Homo sapiens
ccaacacagcaggctgaacaagct

SEQ ID NO: 20070 - DNA, 24 bp, Homo sapiens
cccaacacagcaggctgaacaagc

SEQ ID NO: 20071 - DNA, 24 bp, Homo sapiens
tttcctcttaggctgaacaagctc

SEQ ID NO: 20072 - DNA, 24 bp, Homo sapiens
ctttcctcttaggctgaacaagct

SEQ ID NO: 20073 - DNA, 24 bp, Homo sapiens
tctttcctcttaggctgaacaagc

SEQ ID NO: 20074 - DNA, 24 bp, Homo sapiens
tcgacgagcagatgacaatgaaaa

SEQ ID NO: 20075 - DNA, 24 bp, Homo sapiens
gtcgacgagcagatgacaatgaaa

SEQ ID NO: 20076 - DNA, 24 bp, Homo sapiens
tgtcgacgagcagatgacaatgaa

SEQ ID NO: 20077 - DNA, 24 bp, Homo sapiens
cggtgagcatcagcagaacagcaa

SEQ ID NO: 20078 - DNA, 24 bp, Homo sapiens
cgacctcatgtccatcacagagca

SEQ ID NO: 20079 - DNA, 24 bp, Homo sapiens
aagaaggaaatggcaagcagaagc

SEQ ID NO: 20080 - DNA, 24 bp, Homo sapiens
ggcgagaacaacttcacagacacc

SEQ ID NO: 20081 - DNA, 24 bp, Homo sapiens
agaagatgtgcttgcgatgactgc

SEQ ID NO: 20082 - DNA, 24 bp, Homo sapiens
tcctgctcctgactatcttgctga

SEQ ID NO: 20083 - DNA, 24 bp, Homo sapiens
tcccatcacaattcagcagcaccc

SEQ ID NO: 20084 - DNA, 24 bp, Homo sapiens
tcctgctcctgactatcttgctga

SEQ ID NO: 20085 - DNA, 24 bp, Homo sapiens
agaagatgtgcttgcgatgactgc

SEQ ID NO: 20086 - DNA, 24 bp, Homo sapiens
cacactgttccacacctgccacgc

SEQ ID NO: 20087 - DNA, 24 bp, Homo sapiens
ttgagcccagagaagcccacacac

SEQ ID NO: 20088 - DNA, 24 bp, Homo sapiens
ggactgacaccatctgcaatgaca

SEQ ID NO: 20089 - DNA, 24 bp, Homo sapiens
ggaggaggaggaggatgaggaaga

SEQ ID NO: 20090 - DNA, 24 bp, Homo sapiens
aggaggaatttcagcggcttcagg

SEQ ID NO: 20091 - DNA, 24 bp, Homo sapiens
aatttccaggcagcaacagagtct

SEQ ID NO: 20092 - DNA, 24 bp, Homo sapiens
gtactattgggattttcagcccca

SEQ ID NO: 20093 - DNA, 24 bp, Homo sapiens
caccaagccaggatgaggaagtac

SEQ ID NO: 20094 - DNA, 24 bp, Homo sapiens
ccaccaagccaggatgaggaagta

SEQ ID NO: 20095 - DNA, 24 bp, Homo sapiens
tccaccaagccaggatgaggaagt

SEQ ID NO: 20096 - DNA, 24 bp, Homo sapiens
tggacctcaacagtgtgcttctaa

SEQ ID NO: 20097 - DNA, 24 bp, Homo sapiens
ttcactcgtttcccaatcgcagcc

SEQ ID NO: 20098 - DNA, 24 bp, Homo sapiens
actggacaatacatggactatggc

SEQ ID NO: 20099 - DNA, 24 bp, Homo sapiens
gcctcactaagcaagaccagcagc

SEQ ID NO: 20100 - DNA, 24 bp, Homo sapiens
caggaagtctggctggcaaatggg

SEQ ID NO: 20101 - DNA, 24 bp, Homo sapiens
ggtctgagagtctgtgaagatggc

SEQ ID NO: 20102 - DNA, 24 bp, Homo sapiens
gcccttgccagagtatatggagtg

SEQ ID NO: 20103 - DNA, 24 bp, Homo sapiens
ccaccaagccaggatgaggaagta

SEQ ID NO: 20104 - DNA, 24 bp, Homo sapiens
gcctcactaagcaagaccagcagc

SEQ ID NO: 20105 - DNA, 24 bp, Homo sapiens
actggacaatacatggactatggc

SEQ ID NO: 20106 - DNA, 24 bp, Homo sapiens
gtgaaggatgtaatagatcgtggc

SEQ ID NO: 20107 - DNA, 24 bp, Homo sapiens
aactaattatggttcagcactggc

SEQ ID NO: 20108 - DNA, 24 bp, Homo sapiens
gctggacctcaacagtgtgcttct

SEQ ID NO: 20109 - DNA, 24 bp, Homo sapiens
caggtggatgcgctcaactcccag

SEQ ID NO: 20110 - DNA, 24 bp, Homo sapiens
actttggcagaagcctggaactct

SEQ ID NO: 20111 - DNA, 24 bp, Homo sapiens
cctgcgtgacaaccatgagtggaa

SEQ ID NO: 20112 - DNA, 24 bp, Homo sapiens
actggacaatacatggactatggc

SEQ ID NO: 20113 - DNA, 24 bp, Homo sapiens
gtgaaggatgtaatagatcgtggc

SEQ ID NO: 20114 - DNA, 24 bp, Homo sapiens
ttcactcgtttcccaatcgcagcc

SEQ ID NO: 20115 - DNA, 24 bp, Homo sapiens
tggcagaagcctggaactctacag

SEQ ID NO: 20116 - DNA, 24 bp, Homo sapiens
ggatgcgctcaactcccagaagaa

SEQ ID NO: 20117 - DNA, 24 bp, Homo sapiens
cggttatgtattgcttggtgatgg

SEQ ID NO: 20118 - DNA, 24 bp, Homo sapiens
ctgactgaatgtcgtaatgtggcg

SEQ ID NO: 20119 - DNA, 24 bp, Homo sapiens
taaagcaggtgtggcaaacgggtg

SEQ ID NO: 20120 - DNA, 24 bp, Homo sapiens
gagattacagacagttcactccct

SEQ ID NO: 20121 - DNA, 24 bp, Homo sapiens
tactcctgtgttgtgcggctttgg

SEQ ID NO: 20122 - DNA, 24 bp, Homo sapiens
caggagagcaagtcccacccagtg

SEQ ID NO: 20123 - DNA, 24 bp, Homo sapiens
gcgaatctcattcctgtctcttaa

SEQ ID NO: 20124 - DNA, 24 bp, Homo sapiens
ttcactcgtttcccaatcgcagcc

SEQ ID NO: 20125 - DNA, 24 bp, Homo sapiens
gctggacctcaacagtgtgcttct

SEQ ID NO: 20126 - DNA, 24 bp, Homo sapiens
ccaccaagccaggatgaggaagta

SEQ ID NO: 20127 - DNA, 24 bp, Homo sapiens
ggatgtaatagatcgtggcccttc

SEQ ID NO: 20128 - DNA, 24 bp, Homo sapiens
tggcagaagcctggaactctacag

SEQ ID NO: 20129 - DNA, 24 bp, Homo sapiens
tgcgctcaactcccagaagaagta

SEQ ID NO: 20130 - DNA, 24 bp, Homo sapiens
gcatgggacctgcgccgcccaggt

SEQ ID NO: 20131 - DNA, 24 bp, Homo sapiens
cctcagctcagccccagcaagtgt

SEQ ID NO: 20132 - DNA, 24 bp, Homo sapiens
ccctcagctcagccccagcaagtg

SEQ ID NO: 20133 - DNA, 24 bp, Homo sapiens
cccctcagctcagccccagcaagt

SEQ ID NO: 20134 - DNA, 24 bp, Homo sapiens
ggcagcggcagatttgaggcttaa

SEQ ID NO: 20135 - DNA, 24 bp, Homo sapiens
gggcagcggcagatttgaggctta

SEQ ID NO: 20136 - DNA, 24 bp, Homo sapiens
ggggcagcggcagatttgaggctt

SEQ ID NO: 20137 - DNA, 25 bp, Homo sapiens
aatcacacaacttgtaaagggcaca

SEQ ID NO: 20138 - DNA, 23 bp, Homo sapiens
gacctcgtgattcacctgcctcg

SEQ ID NO: 20139 - DNA, 23 bp, Homo sapiens
gaaagtgctgggattacacacgt

SEQ ID NO: 20140 - DNA, 23 bp, Homo sapiens
ggccaggctggtctcaaattcaa

SEQ ID NO: 20141 - DNA, 25 bp, Homo sapiens
gcagccactgttacaattcaagatc

SEQ ID NO: 20142 - DNA, 23 bp, Homo sapiens
ccagcaatcctcagacgcctcac

SEQ ID NO: 20143 - DNA, 24 bp, Homo sapiens
actgaggcttggtgaagttacgaa

SEQ ID NO: 20144 - DNA, 23 bp, Homo sapiens
gacctcgtgattcacctgcctcg

SEQ ID NO: 20145 - DNA, 23 bp, Homo sapiens
ggccaggctggtctcaaattcaa

SEQ ID NO: 20146 - DNA, 24 bp, Homo sapiens
aggacgtcaaggataactgggatg

SEQ ID NO: 20147 - DNA, 24 bp, Homo sapiens
gaggacgtcaaggataactgggat

SEQ ID NO: 20148 - DNA, 24 bp, Homo sapiens
cgaggacgtcaaggataactggga

SEQ ID NO: 20149 - DNA, 24 bp, Homo sapiens
tcatggacaaggtggtgcggttgt

SEQ ID NO: 20150 - DNA, 24 bp, Homo sapiens
ctcatggacaaggtggtgcggttg

SEQ ID NO: 20151 - DNA, 24 bp, Homo sapiens
gctcatggacaaggtggtgcggtt

SEQ ID NO: 20152 - DNA, 24 bp, Homo sapiens
agacctgctaccagatacctacca

SEQ ID NO: 20153 - DNA, 24 bp, Homo sapiens
gggaagatggagacacttggagaa

SEQ ID NO: 20154 - DNA, 24 bp, Homo sapiens
gcaaaccataagcctcttcaagga

SEQ ID NO: 20155 - DNA, 24 bp, Homo sapiens
tctttcagggagacacatttcgga

SEQ ID NO: 20156 - DNA, 24 bp, Homo sapiens
gtccctcatcttcagccacatgct

SEQ ID NO: 20157 - DNA, 24 bp, Homo sapiens
agcagatgctgcggaattttggag

SEQ ID NO: 20158 - DNA, 24 bp, Homo sapiens
tgccaccacgacttgaccttctgc

SEQ ID NO: 20159 - DNA, 24 bp, Homo sapiens
gcttctaaggctgcttctggctcc

SEQ ID NO: 20160 - DNA, 24 bp, Homo sapiens
atcttccaccaccaccgcctccag

SEQ ID NO: 20161 - DNA, 24 bp, Homo sapiens
tgccaccacgacttgaccttctgc

SEQ ID NO: 20162 - DNA, 24 bp, Homo sapiens
tgtgttccctcaagtgcttctgct

SEQ ID NO: 20163 - DNA, 24 bp, Homo sapiens
attctccatggccccacaagcttc

SEQ ID NO: 20164 - DNA, 24 bp, Homo sapiens
atcttccaccaccaccgcctccag

SEQ ID NO: 20165 - DNA, 24 bp, Homo sapiens
cagaatcccgacctcaaagacgcc

SEQ ID NO: 20166 - DNA, 24 bp, Homo sapiens
cctctagccgccttggagactcat

SEQ ID NO: 20167 - DNA, 24 bp, Homo sapiens
aaccttcctcatctgccaatgcca

SEQ ID NO: 20168 - DNA, 24 bp, Homo sapiens
ctgccagacctcttcctgtgccaa

SEQ ID NO: 20169 - DNA, 24 bp, Homo sapiens
gggagcaatgtgagggtgaagagg

SEQ ID NO: 20170 - DNA, 24 bp, Homo sapiens
tgagtatctgggattacaggcatg

SEQ ID NO: 20171 - DNA, 24 bp, Homo sapiens
gatctcggcttactgcaacctccg

SEQ ID NO: 20172 - DNA, 24 bp, Homo sapiens
ggttcaagcaattcccctgcctca

SEQ ID NO: 20173 - DNA, 24 bp, Homo sapiens
taagagatcctcctccaccgccac

SEQ ID NO: 20174 - DNA, 24 bp, Homo sapiens
aacctggaatcacagcgagttcaa

SEQ ID NO: 20175 - DNA, 24 bp, Homo sapiens
acctccaccaatcccaccagacaa

SEQ ID NO: 20176 - DNA, 24 bp, Homo sapiens
ttccgcgcctgcctgatctccatg

SEQ ID NO: 20177 - DNA, 25 bp, Homo sapiens
atctactatggaggaatgccgacag

SEQ ID NO: 20178 - DNA, 23 bp, Homo sapiens
atgtcaccatcctcaacggcatg

SEQ ID NO: 20179 - DNA, 24 bp, Homo sapiens
gatctgactgagtgtccctacatg

SEQ ID NO: 20180 - DNA, 24 bp, Homo sapiens
tgtcctgcaaggtggtgtgtgatg

SEQ ID NO: 20181 - DNA, 24 bp, Homo sapiens
ctgtcctgcaaggtggtgtgtgat

SEQ ID NO: 20182 - DNA, 24 bp, Homo sapiens
actgtcctgcaaggtggtgtgtga

SEQ ID NO: 20183 - DNA, 24 bp, Homo sapiens
aagtagaacggcaggcagagttaa

SEQ ID NO: 20184 - DNA, 24 bp, Homo sapiens
tgctaaggtaatgctggaggatgg

SEQ ID NO: 20185 - DNA, 24 bp, Homo sapiens
tggcttcgtctgcttctcatctcc

SEQ ID NO: 20186 - DNA, 24 bp, Homo sapiens
tggcttcgtctgcttctcatctcc

SEQ ID NO: 20187 - DNA, 24 bp, Homo sapiens
aaggctcacctgaccaaccagtat

SEQ ID NO: 20188 - DNA, 24 bp, Homo sapiens
cacttcctgccaatgccatcttaa

SEQ ID NO: 20189 - DNA, 24 bp, Homo sapiens
gagtcatcaatcctggagaatgta

SEQ ID NO: 20190 - DNA, 24 bp, Homo sapiens
ggagtcatcaatcctggagaatgt

SEQ ID NO: 20191 - DNA, 24 bp, Homo sapiens
tggagtcatcaatcctggagaatg

SEQ ID NO: 20192 - DNA, 24 bp, Homo sapiens
tttgtgcgttggcattggaggtga

SEQ ID NO: 20193 - DNA, 24 bp, Homo sapiens
ctttgtgcgttggcattggaggtg

SEQ ID NO: 20194 - DNA, 24 bp, Homo sapiens
tctttgtgcgttggcattggaggt

SEQ ID NO: 20195 - DNA, 24 bp, Homo sapiens
cctccttccggccgtccctgcccc

SEQ ID NO: 20196 - DNA, 24 bp, Homo sapiens
ccctccttccggccgtccctgccc

SEQ ID NO: 20197 - DNA, 24 bp, Homo sapiens
accctccttccggccgtccctgcc

SEQ ID NO: 20198 - DNA, 24 bp, Homo sapiens
gcaactcaaaggtgataaaaacaa

SEQ ID NO: 20199 - DNA, 24 bp, Homo sapiens
agcaactcaaaggtgataaaaaca

SEQ ID NO: 20200 - DNA, 24 bp, Homo sapiens
aagcaactcaaaggtgataaaaac

SEQ ID NO: 20201 - DNA, 24 bp, Homo sapiens
cagcagaaggacccccagcaacca

SEQ ID NO: 20202 - DNA, 24 bp, Homo sapiens
ccagcagaaggacccccagcaacc

SEQ ID NO: 20203 - DNA, 24 bp, Homo sapiens
cccagcagaaggacccccagcaac

SEQ ID NO: 20204 - DNA, 24 bp, Homo sapiens
caccacaagtgccgcaagtacagc

SEQ ID NO: 20205 - DNA, 24 bp, Homo sapiens
gccgtctcaaagctccgaaccatc

SEQ ID NO: 20206 - DNA, 24 bp, Homo sapiens
aacaacagatgcctcatcacaccc

SEQ ID NO: 20207 - DNA, 25 bp, Homo sapiens
agtgaccaagaaggctcagtgaagg

SEQ ID NO: 20208 - DNA, 23 bp, Homo sapiens
ctcctcaagcctgcctgtcctgc

SEQ ID NO: 20209 - DNA, 23 bp, Homo sapiens
cttacacctgactgactggagcc

SEQ ID NO: 20210 - DNA, 24 bp, Homo sapiens
attacaggcacgagtcatcacacc

SEQ ID NO: 20211 - DNA, 24 bp, Homo sapiens
tcatctcctgacctcgtgatccgt

SEQ ID NO: 20212 - DNA, 24 bp, Homo sapiens
aggtcagtattcaaccagaggaga

SEQ ID NO: 20213 - DNA, 24 bp, Homo sapiens
gccctgcccaggctgcagtagccg

SEQ ID NO: 20214 - DNA, 24 bp, Homo sapiens
tgccctgcccaggctgcagtagcc

SEQ ID NO: 20215 - DNA, 24 bp, Homo sapiens
ctgccctgcccaggctgcagtagc

SEQ ID NO: 20216 - DNA, 24 bp, Homo sapiens
tgtatttgaagctccataatggga

SEQ ID NO: 20217 - DNA, 24 bp, Homo sapiens
ttgtatttgaagctccataatggg

SEQ ID NO: 20218 - DNA, 24 bp, Homo sapiens
tttgtatttgaagctccataatgg

SEQ ID NO: 20219 - DNA, 24 bp, Homo sapiens
ataacttcagggtgagtctggaga

SEQ ID NO: 20220 - DNA, 24 bp, Homo sapiens
aataacttcagggtgagtctggag

SEQ ID NO: 20221 - DNA, 24 bp, Homo sapiens
aaataacttcagggtgagtctgga

SEQ ID NO: 20222 - DNA, 24 bp, Homo sapiens
tgacaaagaaggagcaccctccgg

SEQ ID NO: 20223 - DNA, 24 bp, Homo sapiens
ctgacaaagaaggagcaccctccg

SEQ ID NO: 20224 - DNA, 24 bp, Homo sapiens
actgacaaagaaggagcaccctcc

SEQ ID NO: 20225 - DNA, 24 bp, Homo sapiens
tcctggaattagagagacaggctg

SEQ ID NO: 20226 - DNA, 24 bp, Homo sapiens
ttcctggaattagagagacaggct

SEQ ID NO: 20227 - DNA, 24 bp, Homo sapiens
attcctggaattagagagacaggc

SEQ ID NO: 20228 - DNA, 24 bp, Homo sapiens
acgaggttatgtctaccatcacgg

SEQ ID NO: 20229 - DNA, 24 bp, Homo sapiens
tgattctcatgttctggaggaggc

SEQ ID NO: 20230 - DNA, 24 bp, Homo sapiens
ccgagttatgggggatattccgat

SEQ ID NO: 20231 - DNA, 24 bp, Homo sapiens
gcttcgtcctgccctgtcctgccc

SEQ ID NO: 20232 - DNA, 24 bp, Homo sapiens
ggcttcgtcctgccctgtcctgcc

SEQ ID NO: 20233 - DNA, 24 bp, Homo sapiens
tggcttcgtcctgccctgtcctgc

SEQ ID NO: 20234 - DNA, 24 bp, Homo sapiens
gcgactgcctcaagacctgccttt

SEQ ID NO: 20235 - DNA, 24 bp, Homo sapiens
tcacgccacaagacctacagcctc

SEQ ID NO: 20236 - DNA, 24 bp, Homo sapiens
tccactctcaactacctccgactc

SEQ ID NO: 20237 - DNA, 24 bp, Homo sapiens
agaggcgggcgatgtgaagatgtc

SEQ ID NO: 20238 - DNA, 24 bp, Homo sapiens
gggcgggcaccgtgactcggctgg

SEQ ID NO: 20239 - DNA, 24 bp, Homo sapiens
gcgggcggcggcggcggctcatgc

SEQ ID NO: 20240 - DNA, 24 bp, Homo sapiens
gaggggccgccgcgggctccgggg

SEQ ID NO: 20241 - DNA, 24 bp, Homo sapiens
gattcttctgccagcctcccgagt

SEQ ID NO: 20242 - DNA, 24 bp, Homo sapiens
cgattcttctgccagcctcccgag

SEQ ID NO: 20243 - DNA, 24 bp, Homo sapiens
gcgattcttctgccagcctcccga

SEQ ID NO: 20244 - DNA, 24 bp, Homo sapiens
ttttacataaggtccccattccaa

SEQ ID NO: 20245 - DNA, 24 bp, Homo sapiens
tttttacataaggtccccattcca

SEQ ID NO: 20246 - DNA, 24 bp, Homo sapiens
ttttttacataaggtccccattcc

SEQ ID NO: 20247 - DNA, 24 bp, Homo sapiens
ccggctcctcatggtcctccagcc

SEQ ID NO: 20248 - DNA, 24 bp, Homo sapiens
cccggctcctcatggtcctccagc

SEQ ID NO: 20249 - DNA, 24 bp, Homo sapiens
gcccggctcctcatggtcctccag

SEQ ID NO: 20250 - DNA, 24 bp, Homo sapiens
tcctgatccagctaaggcaggaac

SEQ ID NO: 20251 - DNA, 24 bp, Homo sapiens
ctcctgatccagctaaggcaggaa

SEQ ID NO: 20252 - DNA, 24 bp, Homo sapiens
cctcctgatccagctaaggcagga

SEQ ID NO: 20253 - DNA, 24 bp, Homo sapiens
aacagcttcaggaacgggctggag

SEQ ID NO: 20254 - DNA, 24 bp, Homo sapiens
aaacagcttcaggaacgggctgga

SEQ ID NO: 20255 - DNA, 24 bp, Homo sapiens
taaacagcttcaggaacgggctgg

SEQ ID NO: 20256 - DNA, 24 bp, Homo sapiens
atttacaattcgtggcactccaca

SEQ ID NO: 20257 - DNA, 24 bp, Homo sapiens
tatttacaattcgtggcactccac

SEQ ID NO: 20258 - DNA, 24 bp, Homo sapiens
ttatttacaattcgtggcactcca

SEQ ID NO: 20259 - DNA, 24 bp, Homo sapiens
ctactgcaatggaatccaaggcat

SEQ ID NO: 20260 - DNA, 24 bp, Homo sapiens
cctactgcaatggaatccaaggca

SEQ ID NO: 20261 - DNA, 24 bp, Homo sapiens
ccctactgcaatggaatccaaggc

SEQ ID NO: 20262 - DNA, 24 bp, Homo sapiens
agtggtatgaggttgagcgcacag

SEQ ID NO: 20263 - DNA, 24 bp, Homo sapiens
cagtggtatgaggttgagcgcaca

SEQ ID NO: 20264 - DNA, 24 bp, Homo sapiens
acagtggtatgaggttgagcgcac

SEQ ID NO: 20265 - DNA, 24 bp, Homo sapiens
gatcagcatatcattcatgtggca

SEQ ID NO: 20266 - DNA, 24 bp, Homo sapiens
tgttttcttggggtgcagggagtg

SEQ ID NO: 20267 - DNA, 24 bp, Homo sapiens
acagtctggccctcagtgaccgag

SEQ ID NO: 20268 - DNA, 24 bp, Homo sapiens
gcttcctaaaggtgtgtggtggca

SEQ ID NO: 20269 - DNA, 24 bp, Homo sapiens
agaactgagggctatgatggtggg

SEQ ID NO: 20270 - DNA, 24 bp, Homo sapiens
tgggaagaactggaagagactgcc

SEQ ID NO: 20271 - DNA, 24 bp, Homo sapiens
gtcctctccagctccctgccgtgg

SEQ ID NO: 20272 - DNA, 24 bp, Homo sapiens
tgtcctctccagctccctgccgtg

SEQ ID NO: 20273 - DNA, 24 bp, Homo sapiens
gtgtcctctccagctccctgccgt

SEQ ID NO: 20274 - DNA, 24 bp, Homo sapiens
aatcggatgctgctggaagtcacc

SEQ ID NO: 20275 - DNA, 24 bp, Homo sapiens
caccaatgagaacccgtcaggacc

SEQ ID NO: 20276 - DNA, 24 bp, Homo sapiens
ccgcttcctcctggtgatgctcag

SEQ ID NO: 20277 - DNA, 24 bp, Homo sapiens
ccgcttcctcctggtgatgctcag

SEQ ID NO: 20278 - DNA, 24 bp, Homo sapiens
cttctgctcaaggtgcttctgcca

SEQ ID NO: 20279 - DNA, 24 bp, Homo sapiens
tgagaggtgtggactggaaatggg

SEQ ID NO: 20280 - DNA, 24 bp, Homo sapiens
ttaaggagagtgactgctgctgct

SEQ ID NO: 20281 - DNA, 24 bp, Homo sapiens
cctggctgctggtcttgagtctct

SEQ ID NO: 20282 - DNA, 24 bp, Homo sapiens
ctagcacctcagaacgatcacgag

SEQ ID NO: 20283 - DNA, 24 bp, Homo sapiens
actccgaagtcccatctgcaactc

SEQ ID NO: 20284 - DNA, 24 bp, Homo sapiens
gctgtctgcatgttcctggcctcc

SEQ ID NO: 20285 - DNA, 24 bp, Homo sapiens
aaagagaccagcccgctgaccgcg

SEQ ID NO: 20286 - DNA, 24 bp, Homo sapiens
ctcatccacagcacgtctgccatg

SEQ ID NO: 20287 - DNA, 24 bp, Homo sapiens
tctcatccacagcacgtctgccat

SEQ ID NO: 20288 - DNA, 24 bp, Homo sapiens
atctcatccacagcacgtctgcca

SEQ ID NO: 20289 - DNA, 24 bp, Homo sapiens
tgagcaccaagctgtccgcccagt

SEQ ID NO: 20290 - DNA, 24 bp, Homo sapiens
ctgagcaccaagctgtccgcccag

SEQ ID NO: 20291 - DNA, 24 bp, Homo sapiens
actgagcaccaagctgtccgccca

SEQ ID NO: 20292 - DNA, 24 bp, Homo sapiens
gttcctggacatgatggcacctcg

SEQ ID NO: 20293 - DNA, 25 bp, Homo sapiens
agtgatgctgctgtccctatcttca

SEQ ID NO: 20294 - DNA, 25 bp, Homo sapiens
tcaatgatccagagcaacacagcca

SEQ ID NO: 20295 - DNA, 24 bp, Homo sapiens
atcttggccaggctggtcttgaac

SEQ ID NO: 20296 - DNA, 24 bp, Homo sapiens
catcttggccaggctggtcttgaa

SEQ ID NO: 20297 - DNA, 24 bp, Homo sapiens
ccatcttggccaggctggtcttga

SEQ ID NO: 20298 - DNA, 23 bp, Homo sapiens
cctggcaccttctacagatgagc

SEQ ID NO: 20299 - DNA, 23 bp, Homo sapiens
gcctggaaaccctgcgaatggaa

SEQ ID NO: 20300 - DNA, 25 bp, Homo sapiens
tgggtgatgtggtcgagaagagttt

SEQ ID NO: 20301 - DNA, 25 bp, Homo sapiens
acagaagatagaaaggcggagaggc

SEQ ID NO: 20302 - DNA, 24 bp, Homo sapiens
cgatatggagagatgctggacaaa

SEQ ID NO: 20303 - DNA, 23 bp, Homo sapiens
agctcccgcctgaatcacatgat

SEQ ID NO: 20304 - DNA, 24 bp, Homo sapiens
cgccacacccggctaatttttagt

SEQ ID NO: 20305 - DNA, 24 bp, Homo sapiens
ccgccacacccggctaatttttag

SEQ ID NO: 20306 - DNA, 24 bp, Homo sapiens
accgccacacccggctaattttta

SEQ ID NO: 20307 - DNA, 23 bp, Homo sapiens
attgctgcgctcccgtgcccaag

SEQ ID NO: 20308 - DNA, 25 bp, Homo sapiens
agccttaactgatgacattccacca

SEQ ID NO: 20309 - DNA, 25 bp, Homo sapiens
tgacctgaagcaactgaagatccac

SEQ ID NO: 20310 - DNA, 24 bp, Homo sapiens
ctcagaccaaccagcccaaggaac

SEQ ID NO: 20311 - DNA, 25 bp, Homo sapiens
ttatcaatgaggtcatccgccacga

SEQ ID NO: 20312 - DNA, 24 bp, Homo sapiens
acatcgtcattctggaggtctgcc

SEQ ID NO: 20313 - DNA, 24 bp, Homo sapiens
aagacctatcacaccagcctcaag

SEQ ID NO: 20314 - DNA, 25 bp, Homo sapiens
aggagatgtggatgaaggagcagat

SEQ ID NO: 20315 - DNA, 25 bp, Homo sapiens
ggaatgggtcgggaagttgagaatc

SEQ ID NO: 20316 - DNA, 25 bp, Homo sapiens
aagtggatgaactgacctgtgagaa

SEQ ID NO: 20317 - DNA, 24 bp, Homo sapiens
gttcaagcactcccaccaaaggca

SEQ ID NO: 20318 - DNA, 25 bp, Homo sapiens
aggagatgtggatgaaggagcagat

SEQ ID NO: 20319 - DNA, 25 bp, Homo sapiens
ggaatgggtcgggaagttgagaatc

SEQ ID NO: 20320 - DNA, 24 bp, Homo sapiens
gctgaagacacagtggacatctcc

SEQ ID NO: 20321 - DNA, 23 bp, Homo sapiens
ggcgtctacacagagcatgtctt

SEQ ID NO: 20322 - DNA, 25 bp, Homo sapiens
ggagttcagatcccagaagacctct

SEQ ID NO: 20323 - DNA, 24 bp, Homo sapiens
gctgaagacacagtggacatctcc

SEQ ID NO: 20324 - DNA, 25 bp, Homo sapiens
caacagcagaagaagcaactgaagc

SEQ ID NO: 20325 - DNA, 24 bp, Homo sapiens
aggaggcatcacagtggttggttg

SEQ ID NO: 20326 - DNA, 24 bp, Homo sapiens
agagccccccgctccggtgcccta

SEQ ID NO: 20327 - DNA, 24 bp, Homo sapiens
cagagccccccgctccggtgccct

SEQ ID NO: 20328 - DNA, 24 bp, Homo sapiens
acagagccccccgctccggtgccc

SEQ ID NO: 20329 - DNA, 24 bp, Homo sapiens
gagaaggtccgggctgagtgggag

SEQ ID NO: 20330 - DNA, 24 bp, Homo sapiens
ggagaagagctgcctgtcacctgg

SEQ ID NO: 20331 - DNA, 24 bp, Homo sapiens
cccaagtcagccaaacccctaagc

SEQ ID NO: 20332 - DNA, 24 bp, Homo sapiens
aagacctaccttggcctccacctg

SEQ ID NO: 20333 - DNA, 25 bp, Homo sapiens
aagttatctacctgcctcagcctcc

SEQ ID NO: 20334 - DNA, 23 bp, Homo sapiens
ggccagaatggttttgaactcct

SEQ ID NO: 20335 - DNA, 24 bp, Homo sapiens
gtccctaacaccagccagtcccag

SEQ ID NO: 20336 - DNA, 24 bp, Homo sapiens
gaagatgtcagctcgccacctcaa

SEQ ID NO: 20337 - DNA, 24 bp, Homo sapiens
cggctcagggatctttgtctcacc

SEQ ID NO: 20338 - DNA, 24 bp, Homo sapiens
gaagatgtcagctcgccacctcaa

SEQ ID NO: 20339 - DNA, 24 bp, Homo sapiens
gtccctaacaccagccagtcccag

SEQ ID NO: 20340 - DNA, 24 bp, Homo sapiens
gcaggaaccgtttgtcatggaagc

SEQ ID NO: 20341 - DNA, 24 bp, Homo sapiens
tctgttcccagcacctgcctttga

SEQ ID NO: 20342 - DNA, 24 bp, Homo sapiens
ttctgttcccagcacctgcctttg

SEQ ID NO: 20343 - DNA, 24 bp, Homo sapiens
tttctgttcccagcacctgccttt

SEQ ID NO: 20344 - DNA, 24 bp, Homo sapiens
catgaaaccagggaatgtgcagca

SEQ ID NO: 20345 - DNA, 24 bp, Homo sapiens
gcatgaaaccagggaatgtgcagc

SEQ ID NO: 20346 - DNA, 24 bp, Homo sapiens
agcatgaaaccagggaatgtgcag

SEQ ID NO: 20347 - DNA, 24 bp, Homo sapiens
tagcaacggacagagagtgaaccc

SEQ ID NO: 20348 - DNA, 24 bp, Homo sapiens
tgttactcctccaccacctccaag

SEQ ID NO: 20349 - DNA, 24 bp, Homo sapiens
ctcccgaatctctcctgtcccacc

SEQ ID NO: 20350 - DNA, 24 bp, Homo sapiens
cgtgctcccggctcccaggtgccc

SEQ ID NO: 20351 - DNA, 24 bp, Homo sapiens
ccgtgctcccggctcccaggtgcc

SEQ ID NO: 20352 - DNA, 24 bp, Homo sapiens
gccgtgctcccggctcccaggtgc

SEQ ID NO: 20353 - DNA, 24 bp, Homo sapiens
gctcaagtgatctgcctgcctcag

SEQ ID NO: 20354 - DNA, 24 bp, Homo sapiens
ttgcccaggctggtcctgaactcc

SEQ ID NO: 20355 - DNA, 24 bp, Homo sapiens
aagtctggtctcctctggtgacgg

SEQ ID NO: 20356 - DNA, 24 bp, Homo sapiens
acaacttgactctcactgtagcca

SEQ ID NO: 20357 - DNA, 24 bp, Homo sapiens
cacacttggaagctcagaacagaa

SEQ ID NO: 20358 - DNA, 24 bp, Homo sapiens
cccaacaagccctcaggattcaga

SEQ ID NO: 20359 - DNA, 24 bp, Homo sapiens
aatgctcagaagttgcctatgtgt

SEQ ID NO: 20360 - DNA, 24 bp, Homo sapiens
actgggattgttggtgtgtttgtg

SEQ ID NO: 20361 - DNA, 24 bp, Homo sapiens
acaacttgactctcactgtagcca

SEQ ID NO: 20362 - DNA, 24 bp, Homo sapiens
aagtctggtctcctctggtgacgg

SEQ ID NO: 20363 - DNA, 24 bp, Homo sapiens
cactactgccagggtcatcacaaa

SEQ ID NO: 20364 - DNA, 24 bp, Homo sapiens
tcccacctcagcacccgtccgtcc

SEQ ID NO: 20365 - DNA, 24 bp, Homo sapiens
ctcccacctcagcacccgtccgtc

SEQ ID NO: 20366 - DNA, 24 bp, Homo sapiens
tctcccacctcagcacccgtccgt

SEQ ID NO: 20367 - DNA, 24 bp, Homo sapiens
aacagcacttcatcaaccaggcag

SEQ ID NO: 20368 - DNA, 23 bp, Homo sapiens
ccaggtgaagagactctcggctt

SEQ ID NO: 20369 - DNA, 23 bp, Homo sapiens
cagacctcgtgcccaaggccaag

SEQ ID NO: 20370 - DNA, 24 bp, Homo sapiens
atccaactctgataggagatgaca

SEQ ID NO: 20371 - DNA, 24 bp, Homo sapiens
gatccaactctgataggagatgac

SEQ ID NO: 20372 - DNA, 24 bp, Homo sapiens
ggatccaactctgataggagatga

SEQ ID NO: 20373 - DNA, 24 bp, Homo sapiens
ttcaccatttgtttgtctttcggg

SEQ ID NO: 20374 - DNA, 24 bp, Homo sapiens
aatgtgaagactcccaactcgtgt

SEQ ID NO: 20375 - DNA, 24 bp, Homo sapiens
gagcatcaactccctttgtcaaga

SEQ ID NO: 20376 - DNA, 25 bp, Homo sapiens
cacagcagaggattcagcccagatg

SEQ ID NO: 20377 - DNA, 24 bp, Homo sapiens
agttcagaatggtgatgtgtcggc

SEQ ID NO: 20378 - DNA, 25 bp, Homo sapiens
tgccatactcagaacaccagaaagc

SEQ ID NO: 20379 - DNA, 24 bp, Homo sapiens
agcagctggaggagttggaggagg

SEQ ID NO: 20380 - DNA, 24 bp, Homo sapiens
aagcagctggaggagttggaggag

SEQ ID NO: 20381 - DNA, 24 bp, Homo sapiens
gaagcagctggaggagttggagga

SEQ ID NO: 20382 - DNA, 23 bp, Homo sapiens
cacgacctcttcttccagcccat

SEQ ID NO: 20383 - DNA, 24 bp, Homo sapiens
atgcctgttcttccccttggagga

SEQ ID NO: 20384 - DNA, 23 bp, Homo sapiens
gaacatcttccccagcctggacg

SEQ ID NO: 20385 - DNA, 24 bp, Homo sapiens
tagggggcaagggtacagctcgca

SEQ ID NO: 20386 - DNA, 24 bp, Homo sapiens
atagggggcaagggtacagctcgc

SEQ ID NO: 20387 - DNA, 24 bp, Homo sapiens
gatagggggcaagggtacagctcg

SEQ ID NO: 20388 - DNA, 24 bp, Homo sapiens
gccgaagaatgattctcctgcctc

SEQ ID NO: 20389 - DNA, 24 bp, Homo sapiens
tgccgaagaatgattctcctgcct

SEQ ID NO: 20390 - DNA, 24 bp, Homo sapiens
ttgccgaagaatgattctcctgcc

SEQ ID NO: 20391 - DNA, 25 bp, Homo sapiens
ggctgatctcaaactcccaacctca

SEQ ID NO: 20392 - DNA, 24 bp, Homo sapiens
atgcaccaccatgcctggctaatt

SEQ ID NO: 20393 - DNA, 24 bp, Homo sapiens
gattagaggcgtgagccactgcac

SEQ ID NO: 20394 - DNA, 24 bp, Homo sapiens
tcgaccctgagctcgcacggtatc

SEQ ID NO: 20395 - DNA, 24 bp, Homo sapiens
atcgaccctgagctcgcacggtat

SEQ ID NO: 20396 - DNA, 24 bp, Homo sapiens
catcgaccctgagctcgcacggta

SEQ ID NO: 20397 - DNA, 24 bp, Homo sapiens
cctggcgctgtcacagtcagaggc

SEQ ID NO: 20398 - DNA, 24 bp, Homo sapiens
ctgcaggaggaggaggagctgcag

SEQ ID NO: 20399 - DNA, 24 bp, Homo sapiens
gcagcgtaaaggtaaagttctcct

SEQ ID NO: 20400 - DNA, 24 bp, Homo sapiens
cgcagcgtaaaggtaaagttctcc

SEQ ID NO: 20401 - DNA, 24 bp, Homo sapiens
ccgcagcgtaaaggtaaagttctc

SEQ ID NO: 20402 - DNA, 24 bp, Homo sapiens
agaccaggatgaagaagaccgtga

SEQ ID NO: 20403 - DNA, 24 bp, Homo sapiens
gaaagaaactccgttccttgaggt

SEQ ID NO: 20404 - DNA, 24 bp, Homo sapiens
ccacatgatgacaaggaagagcaa

SEQ ID NO: 20405 - DNA, 24 bp, Homo sapiens
gtctggaattggtgagttgttttg

SEQ ID NO: 20406 - DNA, 24 bp, Homo sapiens
tgtctggaattggtgagttgtttt

SEQ ID NO: 20407 - DNA, 24 bp, Homo sapiens
gtgtctggaattggtgagttgttt

SEQ ID NO: 20408 - DNA, 24 bp, Homo sapiens
tcatgcctcaggtaggtcttgtca

SEQ ID NO: 20409 - DNA, 24 bp, Homo sapiens
ttcatgcctcaggtaggtcttgtc

SEQ ID NO: 20410 - DNA, 24 bp, Homo sapiens
cttcatgcctcaggtaggtcttgt

SEQ ID NO: 20411 - DNA, 24 bp, Homo sapiens
tgtttccaggcagagggtgagact

SEQ ID NO: 20412 - DNA, 24 bp, Homo sapiens
gcctttctgctgcttcctctaccc

SEQ ID NO: 20413 - DNA, 25 bp, Homo sapiens
gagttatggctgcctctgctgagtc

SEQ ID NO: 20414 - DNA, 24 bp, Homo sapiens
cggactttgtggctgaagatctgc

SEQ ID NO: 20415 - DNA, 24 bp, Homo sapiens
acggactttgtggctgaagatctg

SEQ ID NO: 20416 - DNA, 24 bp, Homo sapiens
tacggactttgtggctgaagatct

SEQ ID NO: 20417 - DNA, 24 bp, Homo sapiens
cggactttgtggtgagttcttcct

SEQ ID NO: 20418 - DNA, 24 bp, Homo sapiens
acggactttgtggtgagttcttcc

SEQ ID NO: 20419 - DNA, 24 bp, Homo sapiens
tacggactttgtggtgagttcttc

SEQ ID NO: 20420 - DNA, 24 bp, Homo sapiens
cggactttgtggttgggcatctgc

SEQ ID NO: 20421 - DNA, 24 bp, Homo sapiens
acggactttgtggttgggcatctg

SEQ ID NO: 20422 - DNA, 24 bp, Homo sapiens
tacggactttgtggttgggcatct

SEQ ID NO: 20423 - DNA, 24 bp, Homo sapiens
cccaccatcccaacaagtcaacta

SEQ ID NO: 20424 - DNA, 24 bp, Homo sapiens
atctcagggactaccaccaccacc

SEQ ID NO: 20425 - DNA, 24 bp, Homo sapiens
tcctcagctacccttgcatctcca

SEQ ID NO: 20426 - DNA, 24 bp, Homo sapiens
gcacaacaccagcctatgaatatc

SEQ ID NO: 20427 - DNA, 24 bp, Homo sapiens
atctcagggactaccaccaccacc

SEQ ID NO: 20428 - DNA, 24 bp, Homo sapiens
gtcaactacattgcttcacaacca

SEQ ID NO: 20429 - DNA, 24 bp, Homo sapiens
caacgaggctttctgagatggcat

SEQ ID NO: 20430 - DNA, 25 bp, Homo sapiens
gatggtctcgaactcctgcactcaa

SEQ ID NO: 20431 - DNA, 23 bp, Homo sapiens
attacaggcgttgagccactgca

SEQ ID NO: 20432 - DNA, 24 bp, Homo sapiens
gcccccggccgacctttggtcacc

SEQ ID NO: 20433 - DNA, 24 bp, Homo sapiens
agcccccggccgacctttggtcac

SEQ ID NO: 20434 - DNA, 24 bp, Homo sapiens
gagcccccggccgacctttggtca

SEQ ID NO: 20435 - DNA, 24 bp, Homo sapiens
ggaatccaacatcaaggttctgcc

SEQ ID NO: 20436 - DNA, 24 bp, Homo sapiens
catcttcttctgtgtcaggtgccg

SEQ ID NO: 20437 - DNA, 24 bp, Homo sapiens
ccaagcagagcggatgtctcagat

SEQ ID NO: 20438 - DNA, 24 bp, Homo sapiens
ctcactggcgtcatctggcatgaa

SEQ ID NO: 20439 - DNA, 24 bp, Homo sapiens
cagcaaaaaactcaagagggggaa

SEQ ID NO: 20440 - DNA, 24 bp, Homo sapiens
agtgctgtgttttcagtcagtggc

SEQ ID NO: 20441 - DNA, 24 bp, Homo sapiens
acttaactcctacccttgacagca

SEQ ID NO: 20442 - DNA, 24 bp, Homo sapiens
atggaatgccgaatcaaacaggat

SEQ ID NO: 20443 - DNA, 24 bp, Homo sapiens
agtcgttggtagtgacaatgagga

SEQ ID NO: 20444 - DNA, 24 bp, Homo sapiens
tcgttggtagtgacaatgaggatg

SEQ ID NO: 20445 - DNA, 24 bp, Homo sapiens
atgtcttatggaatgccgaatcaa

SEQ ID NO: 20446 - DNA, 24 bp, Homo sapiens
agtagagagaagagtcacacagca

SEQ ID NO: 20447 - DNA, 24 bp, Homo sapiens
agtagagagaagagtcacacagca

SEQ ID NO: 20448 - DNA, 24 bp, Homo sapiens
agtcgttggtagtgacaatgagga

SEQ ID NO: 20449 - DNA, 24 bp, Homo sapiens
atggaatgccgaatcaaacaggat

SEQ ID NO: 20450 - DNA, 24 bp, Homo sapiens
cctcttgctccacagttgactact

SEQ ID NO: 20451 - DNA, 24 bp, Homo sapiens
cctcactggcgtcatctggcatga

SEQ ID NO: 20452 - DNA, 24 bp, Homo sapiens
tgcttccttcagttccagccacag

SEQ ID NO: 20453 - DNA, 24 bp, Homo sapiens
cctcactggcgtcatctggcatga

SEQ ID NO: 20454 - DNA, 24 bp, Homo sapiens
tgcttccttcagttccagccacag

SEQ ID NO: 20455 - DNA, 24 bp, Homo sapiens
attctgctccacactgtgcctcac

SEQ ID NO: 20456 - DNA, 24 bp, Homo sapiens
ccaccgcctcctctcaccaagaaa

SEQ ID NO: 20457 - DNA, 24 bp, Homo sapiens
acactgtgcctcactggatataca

SEQ ID NO: 20458 - DNA, 24 bp, Homo sapiens
tgcttccttcagttccagccacag

SEQ ID NO: 20459 - DNA, 24 bp, Homo sapiens
ccaccgcctcctctcaccaagaaa

SEQ ID NO: 20460 - DNA, 24 bp, Homo sapiens
attctgctccacactgtgcctcac

SEQ ID NO: 20461 - DNA, 24 bp, Homo sapiens
tgcttccttcagttccagccacag

SEQ ID NO: 20462 - DNA, 24 bp, Homo sapiens
cccagcagttgaacccaggctttc

SEQ ID NO: 20463 - DNA, 24 bp, Homo sapiens
gcccaagtgtgttgcttccttcag

SEQ ID NO: 20464 - DNA, 24 bp, Homo sapiens
actcagctcttctgctccacacga

SEQ ID NO: 20465 - DNA, 24 bp, Homo sapiens
gcccaagtgtgttgcttccttcag

SEQ ID NO: 20466 - DNA, 24 bp, Homo sapiens
actcagctcttctgctccacacga

SEQ ID NO: 20467 - DNA, 24 bp, Homo sapiens
gacattcttcacctgcctgcctgc

SEQ ID NO: 20468 - DNA, 24 bp, Homo sapiens
tggtctttgtagtgatgcctgttt

SEQ ID NO: 20469 - DNA, 24 bp, Homo sapiens
tttcactctacaaacaacctcacc

SEQ ID NO: 20470 - DNA, 24 bp, Homo sapiens
agtagctctggtccttgccaatcc

SEQ ID NO: 20471 - DNA, 24 bp, Homo sapiens
ttattcagagaagctcgcagaggc

SEQ ID NO: 20472 - DNA, 24 bp, Homo sapiens
acaacgcagaaagccagtcttcca

SEQ ID NO: 20473 - DNA, 24 bp, Homo sapiens
tctacctcagtctaatcctgctgc

SEQ ID NO: 20474 - DNA, 24 bp, Homo sapiens
cgtaaccagagttaccacaccagc

SEQ ID NO: 20475 - DNA, 24 bp, Homo sapiens
tcgtaaccagagttaccacaccag

SEQ ID NO: 20476 - DNA, 24 bp, Homo sapiens
ttcgtaaccagagttaccacacca

SEQ ID NO: 20477 - DNA, 24 bp, Homo sapiens
gtccctccagttcaccactcctcc

SEQ ID NO: 20478 - DNA, 24 bp, Homo sapiens
tccagagcatcttcagtagcaggt

SEQ ID NO: 20479 - DNA, 24 bp, Homo sapiens
ccgaaccttcctgccatccactac

SEQ ID NO: 20480 - DNA, 24 bp, Homo sapiens
tgagtcaggagaatcgcttgagcc

SEQ ID NO: 20481 - DNA, 23 bp, Homo sapiens
gtgagccaagatcatgccactgc

SEQ ID NO: 20482 - DNA, 23 bp, Homo sapiens
gactgggcaacagagggagactc

SEQ ID NO: 20483 - DNA, 24 bp, Homo sapiens
ggctccggcataatacaacttctc

SEQ ID NO: 20484 - DNA, 24 bp, Homo sapiens
gggctccggcataatacaacttct

SEQ ID NO: 20485 - DNA, 24 bp, Homo sapiens
ggggctccggcataatacaacttc

SEQ ID NO: 20486 - DNA, 24 bp, Homo sapiens
gactgggacagtgaacttgaagat

SEQ ID NO: 20487 - DNA, 24 bp, Homo sapiens
ggactgggacagtgaacttgaaga

SEQ ID NO: 20488 - DNA, 24 bp, Homo sapiens
aggactgggacagtgaacttgaag

SEQ ID NO: 20489 - DNA, 23 bp, Homo sapiens
cctcagcagcagccgatcagaag

SEQ ID NO: 20490 - DNA, 24 bp, Homo sapiens
caaggatgatgatgaccccgccac

SEQ ID NO: 20491 - DNA, 25 bp, Homo sapiens
ccacagcagcccaagaacatacaca

SEQ ID NO: 20492 - DNA, 23 bp, Homo sapiens
ttcccaacagtttcagccagccc

SEQ ID NO: 20493 - DNA, 23 bp, Homo sapiens
cctccaccaccaccgcctcctac

SEQ ID NO: 20494 - DNA, 25 bp, Homo sapiens
cattcactcagccaggaccagcatt

SEQ ID NO: 20495 - DNA, 23 bp, Homo sapiens
cctccaccaccaccgcctcctac

SEQ ID NO: 20496 - DNA, 25 bp, Homo sapiens
agccatcctgttcctactcagagtc

SEQ ID NO: 20497 - DNA, 25 bp, Homo sapiens
cattcactcagccaggaccagcatt

SEQ ID NO: 20498 - DNA, 23 bp, Homo sapiens
gtcccgactcagcaggctcaaga

SEQ ID NO: 20499 - DNA, 23 bp, Homo sapiens
ctcaacaagccaggaagtaccgc

SEQ ID NO: 20500 - DNA, 23 bp, Homo sapiens
tcgcctgaagaagaccgccactg

SEQ ID NO: 20501 - DNA, 25 bp, Homo sapiens
tgttcaacctcagcaacgccatcat

SEQ ID NO: 20502 - DNA, 23 bp, Homo sapiens
actccatccacctcctgctgacc

SEQ ID NO: 20503 - DNA, 25 bp, Homo sapiens
gccatgtccagttacctgttcatca

SEQ ID NO: 20504 - DNA, 24 bp, Homo sapiens
ttatggacttggtaagttactaaa

SEQ ID NO: 20505 - DNA, 24 bp, Homo sapiens
tttatggacttggtaagttactaa

SEQ ID NO: 20506 - DNA, 24 bp, Homo sapiens
ctttatggacttggtaagttacta

SEQ ID NO: 20507 - DNA, 24 bp, Homo sapiens
aatactacattgtaagtatgcaaa

SEQ ID NO: 20508 - DNA, 24 bp, Homo sapiens
caatactacattgtaagtatgcaa

SEQ ID NO: 20509 - DNA, 24 bp, Homo sapiens
acaatactacattgtaagtatgca

SEQ ID NO: 20510 - DNA, 24 bp, Homo sapiens
ccaagcgcaagttgtctgatgatc

SEQ ID NO: 20511 - DNA, 24 bp, Homo sapiens
gccaagcgcaagttgtctgatgat

SEQ ID NO: 20512 - DNA, 24 bp, Homo sapiens
tgccaagcgcaagttgtctgatga

SEQ ID NO: 20513 - DNA, 24 bp, Homo sapiens
ttaaattctagttgtctgatgatc

SEQ ID NO: 20514 - DNA, 24 bp, Homo sapiens
cttaaattctagttgtctgatgat

SEQ ID NO: 20515 - DNA, 24 bp, Homo sapiens
acttaaattctagttgtctgatga

SEQ ID NO: 20516 - DNA, 24 bp, Homo sapiens
cgcttattaaaaattcctccctgt

SEQ ID NO: 20517 - DNA, 24 bp, Homo sapiens
tcgcttattaaaaattcctccctg

SEQ ID NO: 20518 - DNA, 24 bp, Homo sapiens
ttcgcttattaaaaattcctccct

SEQ ID NO: 20519 - DNA, 24 bp, Homo sapiens
tagggagcaaggaccatcccggca

SEQ ID NO: 20520 - DNA, 24 bp, Homo sapiens
ctagggagcaaggaccatcccggc

SEQ ID NO: 20521 - DNA, 24 bp, Homo sapiens
actagggagcaaggaccatcccgg

SEQ ID NO: 20522 - DNA, 24 bp, Homo sapiens
agttattacaggtactgtttgata

SEQ ID NO: 20523 - DNA, 24 bp, Homo sapiens
cagttattacaggtactgtttgat

SEQ ID NO: 20524 - DNA, 24 bp, Homo sapiens
tcagttattacaggtactgtttga

SEQ ID NO: 20525 - DNA, 24 bp, Homo sapiens
caggactaaagacgttcctgaata

SEQ ID NO: 20526 - DNA, 24 bp, Homo sapiens
ccaggactaaagacgttcctgaat

SEQ ID NO: 20527 - DNA, 24 bp, Homo sapiens
accaggactaaagacgttcctgaa

SEQ ID NO: 20528 - DNA, 24 bp, Homo sapiens
tagtccacatggaactcttgaccc

SEQ ID NO: 20529 - DNA, 24 bp, Homo sapiens
ctagtccacatggaactcttgacc

SEQ ID NO: 20530 - DNA, 24 bp, Homo sapiens
gctagtccacatggaactcttgac

SEQ ID NO: 20531 - DNA, 24 bp, Homo sapiens
aacaagaaacgctgcagctgataa

SEQ ID NO: 20532 - DNA, 24 bp, Homo sapiens
caacaagaaacgctgcagctgata

SEQ ID NO: 20533 - DNA, 24 bp, Homo sapiens
tcaacaagaaacgctgcagctgat

SEQ ID NO: 20534 - DNA, 24 bp, Homo sapiens
ttgttttgtagctgcagctgataa

SEQ ID NO: 20535 - DNA, 23 bp, Homo sapiens
cttgttttgtagctgcagctgat

SEQ ID NO: 20536 - DNA, 24 bp, Homo sapiens
ccttgttttgtagctgcagctgat

SEQ ID NO: 20537 - DNA, 24 bp, Homo sapiens
tgtgtatacagcttcaactaactc

SEQ ID NO: 20538 - DNA, 24 bp, Homo sapiens
gtgtgtatacagcttcaactaact

SEQ ID NO: 20539 - DNA, 24 bp, Homo sapiens
tgtgtgtatacagcttcaactaac

SEQ ID NO: 20540 - DNA, 24 bp, Homo sapiens
tgctattttttgtaagtaccaccc

SEQ ID NO: 20541 - DNA, 24 bp, Homo sapiens
atgctattttttgtaagtaccacc

SEQ ID NO: 20542 - DNA, 24 bp, Homo sapiens
aatgctattttttgtaagtaccac

SEQ ID NO: 20543 - DNA, 24 bp, Homo sapiens
tatttatgcagatcgaccacttat

SEQ ID NO: 20544 - DNA, 24 bp, Homo sapiens
ttatttatgcagatcgaccactta

SEQ ID NO: 20545 - DNA, 24 bp, Homo sapiens
cttatttatgcagatcgaccactt

SEQ ID NO: 20546 - DNA, 24 bp, Homo sapiens
ggctctggaccgctctcttcttga

SEQ ID NO: 20547 - DNA, 24 bp, Homo sapiens
ccgcacttgggtagcagagttagt

SEQ ID NO: 20548 - DNA, 24 bp, Homo sapiens
tggcacttctactagggagcaagg

SEQ ID NO: 20549 - DNA, 24 bp, Homo sapiens
cgttctctaccagacatacctgct

SEQ ID NO: 20550 - DNA, 24 bp, Homo sapiens
ctgttgtctgagcctgttggtggt

SEQ ID NO: 20551 - DNA, 24 bp, Homo sapiens
tggcacttctactagggagcaagg

SEQ ID NO: 20552 - DNA, 24 bp, Homo sapiens
gtcaccaagtggacgagcagggaa

SEQ ID NO: 20553 - DNA, 24 bp, Homo sapiens
aggatctcctcaagtgtctggccc

SEQ ID NO: 20554 - DNA, 24 bp, Homo sapiens
aaaaatgtgcgaaaattattcctc

SEQ ID NO: 20555 - DNA, 24 bp, Homo sapiens
gaaaaatgtgcgaaaattattcct

SEQ ID NO: 20556 - DNA, 24 bp, Homo sapiens
ggaaaaatgtgcgaaaattattcc

SEQ ID NO: 20557 - DNA, 24 bp, Homo sapiens
tcagcttcatccatcaactggtgc

SEQ ID NO: 20558 - DNA, 24 bp, Homo sapiens
ggctctttgctgatgagaaacctc

SEQ ID NO: 20559 - DNA, 24 bp, Homo sapiens
aagtgcctctccctttcagtttgg

SEQ ID NO: 20560 - DNA, 24 bp, Homo sapiens
aatactacattttgtctgatgatc

SEQ ID NO: 20561 - DNA, 24 bp, Homo sapiens
caatactacattttgtctgatgat

SEQ ID NO: 20562 - DNA, 24 bp, Homo sapiens
acaatactacattttgtctgatga

SEQ ID NO: 20563 - DNA, 24 bp, Homo sapiens
tagtccacatggaactcttgaccc

SEQ ID NO: 20564 - DNA, 24 bp, Homo sapiens
ctagtccacatggaactcttgacc

SEQ ID NO: 20565 - DNA, 24 bp, Homo sapiens
gctagtccacatggaactcttgac

SEQ ID NO: 20566 - DNA, 24 bp, Homo sapiens
ctcgcatggaatctcaataggacc

SEQ ID NO: 20567 - DNA, 24 bp, Homo sapiens
cccatcaccagcgtcatttgttcc

SEQ ID NO: 20568 - DNA, 24 bp, Homo sapiens
agcacagtcaatcagtctccctca

SEQ ID NO: 20569 - DNA, 24 bp, Homo sapiens
gccaaagaacatctgaggaaacta

SEQ ID NO: 20570 - DNA, 24 bp, Homo sapiens
cgccaaagaacatctgaggaaact

SEQ ID NO: 20571 - DNA, 24 bp, Homo sapiens
cgccaaagaacatctgaggaaact

SEQ ID NO: 20572 - DNA, 24 bp, Homo sapiens
tggccctacaggtcagaatggcgg

SEQ ID NO: 20573 - DNA, 24 bp, Homo sapiens
ttggccctacaggtcagaatggcg

SEQ ID NO: 20574 - DNA, 24 bp, Homo sapiens
ttggccctacaggtcagaatggcg

SEQ ID NO: 20575 - DNA, 24 bp, Homo sapiens
acaccttccgagtgtctgctcact

SEQ ID NO: 20576 - DNA, 24 bp, Homo sapiens
gacaccttccgagtgtctgctcac

SEQ ID NO: 20577 - DNA, 24 bp, Homo sapiens
gacaccttccgagtgtctgctcac

SEQ ID NO: 20578 - DNA, 24 bp, Homo sapiens
acacctcccgagtgtctgctcact

SEQ ID NO: 20579 - DNA, 24 bp, Homo sapiens
gacacctcccgagtgtctgctcac

SEQ ID NO: 20580 - DNA, 24 bp, Homo sapiens
gacacctcccgagtgtctgctcac

SEQ ID NO: 20581 - DNA, 24 bp, Homo sapiens
acaccttccgagtgtgtgctctat

SEQ ID NO: 20582 - DNA, 24 bp, Homo sapiens
gacaccttccgagtgtgtgctcta

SEQ ID NO: 20583 - DNA, 24 bp, Homo sapiens
gacaccttccgagtgtgtgctcta

SEQ ID NO: 20584 - DNA, 24 bp, Homo sapiens
tccgtaagatgaaggtgacaacaa

SEQ ID NO: 20585 - DNA, 24 bp, Homo sapiens
tggagacaggtggaaaccaaagtt

SEQ ID NO: 20586 - DNA, 24 bp, Homo sapiens
caaccgccgtagacaggaaggaat

SEQ ID NO: 20587 - DNA, 24 bp, Homo sapiens
tttgcaaccgggtcagaatggcgg

SEQ ID NO: 20588 - DNA, 24 bp, Homo sapiens
ctttgcaaccgggtcagaatggcg

SEQ ID NO: 20589 - DNA, 24 bp, Homo sapiens
tctttgcaaccgggtcagaatggc

SEQ ID NO: 20590 - DNA, 24 bp, Homo sapiens
tccgtaagatgaaggtgacaacaa

SEQ ID NO: 20591 - DNA, 24 bp, Homo sapiens
tggagacaggtggaaaccaaagtt

SEQ ID NO: 20592 - DNA, 24 bp, Homo sapiens
tcatgacaaaatcaatggaaagag

SEQ ID NO: 20593 - DNA, 24 bp, Homo sapiens
gccaaagaacatctgaggaaacta

SEQ ID NO: 20594 - DNA, 24 bp, Homo sapiens
cgccaaagaacatctgaggaaact

SEQ ID NO: 20595 - DNA, 24 bp, Homo sapiens
ccgccaaagaacatctgaggaaac

SEQ ID NO: 20596 - DNA, 24 bp, Homo sapiens
gagaggcaggtgtcagaggcagag

SEQ ID NO: 20597 - DNA, 24 bp, Homo sapiens
cggcagtggagcatcgtcattctt

SEQ ID NO: 20598 - DNA, 24 bp, Homo sapiens
gccacctcctccaactcaacaaca

SEQ ID NO: 20599 - DNA, 24 bp, Homo sapiens
cggcagtggagcatcgtcattctt

SEQ ID NO: 20600 - DNA, 24 bp, Homo sapiens
gccacctcctccaactcaacaaca

SEQ ID NO: 20601 - DNA, 24 bp, Homo sapiens
gagcctcaagacaccttccgagtg

SEQ ID NO: 20602 - DNA, 24 bp, Homo sapiens
gagcatcgtcattcttcaggattg

SEQ ID NO: 20603 - DNA, 24 bp, Homo sapiens
gccacctcctccaactcaacaaca

SEQ ID NO: 20604 - DNA, 24 bp, Homo sapiens
gagcctcaagacaccttccgagtg

SEQ ID NO: 20605 - DNA, 24 bp, Homo sapiens
acaccttccgagtgtctgctcact

SEQ ID NO: 20606 - DNA, 24 bp, Homo sapiens
gacaccttccgagtgtctgctcac

SEQ ID NO: 20607 - DNA, 24 bp, Homo sapiens
agacaccttccgagtgtctgctca

SEQ ID NO: 20608 - DNA, 24 bp, Homo sapiens
ggcgggcagaggactactacagat

SEQ ID NO: 20609 - DNA, 24 bp, Homo sapiens
gagaggcaggtgtcagaggcagag

SEQ ID NO: 20610 - DNA, 24 bp, Homo sapiens
ggaaagaggaagaccgccaaagaa

SEQ ID NO: 20611 - DNA, 24 bp, Homo sapiens
cacctgcggagtgtctgctctatc

SEQ ID NO: 20612 - DNA, 24 bp, Homo sapiens
gcggatgataatctcaagacacct

SEQ ID NO: 20613 - DNA, 24 bp, Homo sapiens
agcggatgataatctcaagacacc

SEQ ID NO: 20614 - DNA, 24 bp, Homo sapiens
cccaccaggaggtaatgcaaccag

SEQ ID NO: 20615 - DNA, 24 bp, Homo sapiens
ccccaccaggaggtaatgcaacca

SEQ ID NO: 20616 - DNA, 24 bp, Homo sapiens
accccaccaggaggtaatgcaacc

SEQ ID NO: 20617 - DNA, 24 bp, Homo sapiens
cggtcgccaggacaatggacttcc

SEQ ID NO: 20618 - DNA, 24 bp, Homo sapiens
tggagcaccaggtgatcctcaggt

SEQ ID NO: 20619 - DNA, 24 bp, Homo sapiens
cccaagattcacacctgactctga

SEQ ID NO: 20620 - DNA, 24 bp, Homo sapiens
gaggcattatgtatattatttccg

SEQ ID NO: 20621 - DNA, 24 bp, Homo sapiens
ggaggcattatgtatattatttcc

SEQ ID NO: 20622 - DNA, 24 bp, Homo sapiens
gggaggcattatgtatattatttc

SEQ ID NO: 20623 - DNA, 23 bp, Homo sapiens
atccaaatcagcccttgagattt

SEQ ID NO: 20624 - DNA, 23 bp, Homo sapiens
aactgcacccactgaactccgca

SEQ ID NO: 20625 - DNA, 23 bp, Homo sapiens
actcaccctcccagtgtgcttga

SEQ ID NO: 20626 - DNA, 23 bp, Homo sapiens
atccaaggtcactcggaagaggc

SEQ ID NO: 20627 - DNA, 24 bp, Homo sapiens
catgacacaaggtaagactgccaa

SEQ ID NO: 20628 - DNA, 25 bp, Homo sapiens
ttcaggaggatgtcttcactggtgg

SEQ ID NO: 20629 - DNA, 25 bp, Homo sapiens
ttcaggaggatgtcttcactggtgg

SEQ ID NO: 20630 - DNA, 25 bp, Homo sapiens
gggctgtccagattatgaatgggct

SEQ ID NO: 20631 - DNA, 23 bp, Homo sapiens
ggtcttctgatgatcccagcagg

SEQ ID NO: 20632 - DNA, 24 bp, Homo sapiens
catgacacaagagccaatgaaagg

SEQ ID NO: 20633 - DNA, 24 bp, Homo sapiens
gcatgacacaagagccaatgaaag

SEQ ID NO: 20634 - DNA, 24 bp, Homo sapiens
tgcatgacacaagagccaatgaaa

SEQ ID NO: 20635 - DNA, 23 bp, Homo sapiens
ggatcactcctggcagcaacgga

SEQ ID NO: 20636 - DNA, 23 bp, Homo sapiens
gcacccatctgtgtgactgtgtg

SEQ ID NO: 20637 - DNA, 25 bp, Homo sapiens
ttcaggaggatgtcttcactggtgg

SEQ ID NO: 20638 - DNA, 24 bp, Homo sapiens
caatccaaaagggagccaagaagg

SEQ ID NO: 20639 - DNA, 24 bp, Homo sapiens
gcaatccaaaagggagccaagaag

SEQ ID NO: 20640 - DNA, 24 bp, Homo sapiens
agcaatccaaaagggagccaagaa

SEQ ID NO: 20641 - DNA, 24 bp, Homo sapiens
acaggaggcaggccagttacaaag

SEQ ID NO: 20642 - DNA, 24 bp, Homo sapiens
gacaggaggcaggccagttacaaa

SEQ ID NO: 20643 - DNA, 24 bp, Homo sapiens
ggacaggaggcaggccagttacaa

SEQ ID NO: 20644 - DNA, 24 bp, Homo sapiens
gctagtggaagttactgccgcgcc

SEQ ID NO: 20645 - DNA, 24 bp, Homo sapiens
acctcattcccacaccacctgaaa

SEQ ID NO: 20646 - DNA, 24 bp, Homo sapiens
tgacaggaaacatcccaacatggc

SEQ ID NO: 20647 - DNA, 24 bp, Homo sapiens
accaacccagaaatcaaccagtct

SEQ ID NO: 20648 - DNA, 24 bp, Homo sapiens
atattgctcagacttccaaagcac

SEQ ID NO: 20649 - DNA, 24 bp, Homo sapiens
catattgctcagacttccaaagca

SEQ ID NO: 20650 - DNA, 24 bp, Homo sapiens
gcatattgctcagacttccaaagc

SEQ ID NO: 20651 - DNA, 24 bp, Homo sapiens
ccagcatgagcaaatgaacgccac

SEQ ID NO: 20652 - DNA, 24 bp, Homo sapiens
agagcgagaactggagattaaact

SEQ ID NO: 20653 - DNA, 24 bp, Homo sapiens
gctgaaacggaaagattagtgaaa

SEQ ID NO: 20654 - DNA, 24 bp, Homo sapiens
ggcatcttcttctgaaacccatct

SEQ ID NO: 20655 - DNA, 24 bp, Homo sapiens
tgccagcgttacctgacaacagtg

SEQ ID NO: 20656 - DNA, 24 bp, Homo sapiens
tcaagccagagacaatctagcact

SEQ ID NO: 20657 - DNA, 24 bp, Homo sapiens
cagcagttgcggaagactttcggc

SEQ ID NO: 20658 - DNA, 24 bp, Homo sapiens
ctggggaagatggcggtggctggg

SEQ ID NO: 20659 - DNA, 24 bp, Homo sapiens
tccggggagccgctggtgcactgg

SEQ ID NO: 20660 - DNA, 24 bp, Homo sapiens
gcccggcatagtgaacacctacct

SEQ ID NO: 20661 - DNA, 24 bp, Homo sapiens
cgcccggcatagtgaacacctacc

SEQ ID NO: 20662 - DNA, 24 bp, Homo sapiens
gcgcccggcatagtgaacacctac

SEQ ID NO: 20663 - DNA, 24 bp, Homo sapiens
cttctccaaagacccaaccatcaa

SEQ ID NO: 20664 - DNA, 24 bp, Homo sapiens
ggtcactggaagccttctgattgc

SEQ ID NO: 20665 - DNA, 24 bp, Homo sapiens
ccagtcctgttcagacacctgctt

SEQ ID NO: 20666 - DNA, 22 bp, Homo sapiens
ctcaagcgattctcctgcctca

SEQ ID NO: 20667 - DNA, 22 bp, Homo sapiens
ccaagtagctgggattacaggc

SEQ ID NO: 20668 - DNA, 24 bp, Homo sapiens
tttctgtccaggagctcgcccgtc

SEQ ID NO: 20669 - DNA, 24 bp, Homo sapiens
ttttctgtccaggagctcgcccgt

SEQ ID NO: 20670 - DNA, 24 bp, Homo sapiens
attttctgtccaggagctcgcccg

SEQ ID NO: 20671 - DNA, 24 bp, Homo sapiens
acacatgagaggtttggacaaaga

SEQ ID NO: 20672 - DNA, 24 bp, Homo sapiens
tacacatgagaggtttggacaaag

SEQ ID NO: 20673 - DNA, 24 bp, Homo sapiens
gtacacatgagaggtttggacaaa

SEQ ID NO: 20674 - DNA, 24 bp, Homo sapiens
ccacctgtagctcctcgaccttct

SEQ ID NO: 20675 - DNA, 24 bp, Homo sapiens
gcaccatctcgccaccgattgtta

SEQ ID NO: 20676 - DNA, 24 bp, Homo sapiens
gcatatccgcccgaaatctccagg

SEQ ID NO: 20677 - DNA, 23 bp, Homo sapiens
acttcatgatctgcccgcctcgg

SEQ ID NO: 20678 - DNA, 23 bp, Homo sapiens
atgttggccaggatggtcttgat

SEQ ID NO: 20679 - DNA, 23 bp, Homo sapiens
agatggagtctcgctctgtcgcc

SEQ ID NO: 20680 - DNA, 23 bp, Homo sapiens
cacctgcctcagcctctggagta

SEQ ID NO: 20681 - DNA, 23 bp, Homo sapiens
caagctctgcctcccaggttcgc

SEQ ID NO: 20682 - DNA, 24 bp, Homo sapiens
caatgtggaaggtctggcgcacct

SEQ ID NO: 20683 - DNA, 24 bp, Homo sapiens
acaatgtggaaggtctggcgcacc

SEQ ID NO: 20684 - DNA, 24 bp, Homo sapiens
aacaatgtggaaggtctggcgcac

SEQ ID NO: 20685 - DNA, 24 bp, Homo sapiens
cctgacaaaaaatgtggaaatgta

SEQ ID NO: 20686 - DNA, 24 bp, Homo sapiens
ccctgacaaaaaatgtggaaatgt

SEQ ID NO: 20687 - DNA, 24 bp, Homo sapiens
gccctgacaaaaaatgtggaaatg

SEQ ID NO: 20688 - DNA, 24 bp, Homo sapiens
atgtcttacagacgccacaggtca

SEQ ID NO: 20689 - DNA, 24 bp, Homo sapiens
tatgtcttacagacgccacaggtc

SEQ ID NO: 20690 - DNA, 24 bp, Homo sapiens
ttatgtcttacagacgccacaggt

SEQ ID NO: 20691 - DNA, 24 bp, Homo sapiens
atgtggtcgggagaaaacaactga

SEQ ID NO: 20692 - DNA, 24 bp, Homo sapiens
gatgtggtcgggagaaaacaactg

SEQ ID NO: 20693 - DNA, 24 bp, Homo sapiens
cgatgtggtcgggagaaaacaact

SEQ ID NO: 20694 - DNA, 24 bp, Homo sapiens
agaaagaacaggatatggtggtgg

SEQ ID NO: 20695 - DNA, 24 bp, Homo sapiens
aagaaagaacaggatatggtggtg

SEQ ID NO: 20696 - DNA, 24 bp, Homo sapiens
gaagaaagaacaggatatggtggt

SEQ ID NO: 20697 - DNA, 24 bp, Homo sapiens
aatatgatgagtttggacgtaaaa

SEQ ID NO: 20698 - DNA, 24 bp, Homo sapiens
gaatatgatgagtttggacgtaaa

SEQ ID NO: 20699 - DNA, 24 bp, Homo sapiens
tgaatatgatgagtttggacgtaa

SEQ ID NO: 20700 - DNA, 24 bp, Homo sapiens
agttagatgaggatgaggatgaag

SEQ ID NO: 20701 - DNA, 24 bp, Homo sapiens
aagttagatgaggatgaggatgaa

SEQ ID NO: 20702 - DNA, 24 bp, Homo sapiens
taagttagatgaggatgaggatga

SEQ ID NO: 20703 - DNA, 25 bp, Homo sapiens
acgatcttcatcacgctcatcctcc

SEQ ID NO: 20704 - DNA, 25 bp, Homo sapiens
tgatgccagtgaagaagaagatagt

SEQ ID NO: 20705 - DNA, 25 bp, Homo sapiens
tgaggatgaggatgaagatgacgct

SEQ ID NO: 20706 - DNA, 25 bp, Homo sapiens
cattctggttcccgttcaagttcaa

SEQ ID NO: 20707 - DNA, 25 bp, Homo sapiens
agaaagaacaggatatggtggtggt

SEQ ID NO: 20708 - DNA, 25 bp, Homo sapiens
gggcactgaaataggaaagacactt

SEQ ID NO: 20709 - DNA, 24 bp, Homo sapiens
tggtcgggagaaaacaactgaggc

SEQ ID NO: 20710 - DNA, 25 bp, Homo sapiens
agaatgcaactgtcatctgtcagcc

SEQ ID NO: 20711 - DNA, 25 bp, Homo sapiens
gcaattcagaagctgtatgtcgaag

SEQ ID NO: 20712 - DNA, 25 bp, Homo sapiens
aaattgcttcatgccctttgtctat

SEQ ID NO: 20713 - DNA, 24 bp, Homo sapiens
gctgcctattcaacattgccatgc

SEQ ID NO: 20714 - DNA, 23 bp, Homo sapiens
tgatgttgggattcttcgcagcc

SEQ ID NO: 20715 - DNA, 25 bp, Homo sapiens
acctgaccctcttccaatgatctct

SEQ ID NO: 20716 - DNA, 25 bp, Homo sapiens
gggcactgaaataggaaagacactt

SEQ ID NO: 20717 - DNA, 24 bp, Homo sapiens
tggtcgggagaaaacaactgaggc

SEQ ID NO: 20718 - DNA, 23 bp, Homo sapiens
tgctggtggcgttcaagatgtcg

SEQ ID NO: 20719 - DNA, 25 bp, Homo sapiens
agaaagaacaggatatggtggtggt

SEQ ID NO: 20720 - DNA, 24 bp, Homo sapiens
acagagggaaagcagttggtcctg

SEQ ID NO: 20721 - DNA, 25 bp, Homo sapiens
ggagaagaagaggatgaggatgaag

SEQ ID NO: 20722 - DNA, 23 bp, Homo sapiens
tcctgggttcacgccgttctcct

SEQ ID NO: 20723 - DNA, 25 bp, Homo sapiens
gcctctctgagaagctgggactaca

SEQ ID NO: 20724 - DNA, 23 bp, Homo sapiens
cgccaccacgcccggctaatttt

SEQ ID NO: 20725 - DNA, 23 bp, Homo sapiens
atctcctgacctcgtgatccgcc

SEQ ID NO: 20726 - DNA, 24 bp, Homo sapiens
ccaaggtgctgggattacaagcgt

SEQ ID NO: 20727 - DNA, 23 bp, Homo sapiens
agctcactgcaacctctacctcc

SEQ ID NO: 20728 - DNA, 24 bp, Homo sapiens
aagcgattttcctgcctcagcctc

SEQ ID NO: 20729 - DNA, 24 bp, Homo sapiens
gctggacgaagaaattagcagagt

SEQ ID NO: 20730 - DNA, 24 bp, Homo sapiens
tgctggacgaagaaattagcagag

SEQ ID NO: 20731 - DNA, 24 bp, Homo sapiens
ctgctggacgaagaaattagcaga

SEQ ID NO: 20732 - DNA, 25 bp, Homo sapiens
ccaggctgctccaaggatcattact

SEQ ID NO: 20733 - DNA, 24 bp, Homo sapiens
cacctacagagatgccaacattaa

SEQ ID NO: 20734 - DNA, 25 bp, Homo sapiens
ggagaagacagcctgaagaagatgc

SEQ ID NO: 20735 - DNA, 25 bp, Homo sapiens
cctacacattggcaccagctacatc

SEQ ID NO: 20736 - DNA, 25 bp, Homo sapiens
gcccgaagctggtttaatctataca

SEQ ID NO: 20737 - DNA, 23 bp, Homo sapiens
ggaactcctcacccaactgctgc

SEQ ID NO: 20738 - DNA, 25 bp, Homo sapiens
ccttggacctagaggacttacagcc

SEQ ID NO: 20739 - DNA, 24 bp, Homo sapiens
atggtccgaggcaaaggctcaatg

SEQ ID NO: 20740 - DNA, 25 bp, Homo sapiens
atcactgtggaagatgctcagaaca

SEQ ID NO: 20741 - DNA, 25 bp, Homo sapiens
gcctgatgctgtgggacctattgtt

SEQ ID NO: 20742 - DNA, 25 bp, Homo sapiens
ccttggacctagaggacttacagcc

SEQ ID NO: 20743 - DNA, 25 bp, Homo sapiens
atcactgtggaagatgctcagaaca

SEQ ID NO: 20744 - DNA, 24 bp, Homo sapiens
aactccaccaggtaaaagacaagt

SEQ ID NO: 20745 - DNA, 24 bp, Homo sapiens
aaactccaccaggtaaaagacaag

SEQ ID NO: 20746 - DNA, 24 bp, Homo sapiens
gaaactccaccaggtaaaagacaa

SEQ ID NO: 20747 - DNA, 24 bp, Homo sapiens
atgtcactgaggtaagattgagtc

SEQ ID NO: 20748 - DNA, 24 bp, Homo sapiens
gatgtcactgaggtaagattgagt

SEQ ID NO: 20749 - DNA, 24 bp, Homo sapiens
ggatgtcactgaggtaagattgag

SEQ ID NO: 20750 - DNA, 24 bp, Homo sapiens
accaactctggcttgttatggagt

SEQ ID NO: 20751 - DNA, 24 bp, Homo sapiens
gaccaactctggcttgttatggag

SEQ ID NO: 20752 - DNA, 24 bp, Homo sapiens
tgaccaactctggcttgttatgga

SEQ ID NO: 20753 - DNA, 24 bp, Homo sapiens
agcagaatagccaggcaggacaga

SEQ ID NO: 20754 - DNA, 25 bp, Homo sapiens
tccaagtctgaaggctctccatctc

SEQ ID NO: 20755 - DNA, 23 bp, Homo sapiens
cctgctggcgaagtggatctgac

SEQ ID NO: 20756 - DNA, 24 bp, Homo sapiens
cctgatgctgctggacagaagtgg

SEQ ID NO: 20757 - DNA, 25 bp, Homo sapiens
aaggctcagtggtcaatgtgaatcc

SEQ ID NO: 20758 - DNA, 23 bp, Homo sapiens
ggatgagaccagaagccataagg

SEQ ID NO: 20759 - DNA, 23 bp, Homo sapiens
tctcgctcccctgttctgtcccg

SEQ ID NO: 20760 - DNA, 23 bp, Homo sapiens
ctgcagggcagtgggcagcagaa

SEQ ID NO: 20761 - DNA, 23 bp, Homo sapiens
ggcaggacagagaaactccacca

SEQ ID NO: 20762 - DNA, 23 bp, Homo sapiens
ggatgagaccagaagccataagg

SEQ ID NO: 20763 - DNA, 23 bp, Homo sapiens
cggaaaggctcagtggtcaatgt

SEQ ID NO: 20764 - DNA, 25 bp, Homo sapiens
cggagattcgtaaatacaagaagag

SEQ ID NO: 20765 - DNA, 24 bp, Homo sapiens
gattaggaaaagtacagctgctct

SEQ ID NO: 20766 - DNA, 24 bp, Homo sapiens
tgattaggaaaagtacagctgctc

SEQ ID NO: 20767 - DNA, 24 bp, Homo sapiens
gtgattaggaaaagtacagctgct

SEQ ID NO: 20768 - DNA, 24 bp, Homo sapiens
ggcgagtccagtagcaagacctca

SEQ ID NO: 20769 - DNA, 24 bp, Homo sapiens
ccataaccatcactgtgccactgg

SEQ ID NO: 20770 - DNA, 24 bp, Homo sapiens
ggcatcttgaaatgtcccgctgaa

SEQ ID NO: 20771 - DNA, 24 bp, Homo sapiens
ccgtctgagatgcctgaccagttc

SEQ ID NO: 20772 - DNA, 25 bp, Homo sapiens
tagaacgaggagacagggcagaagg

SEQ ID NO: 20773 - DNA, 25 bp, Homo sapiens
caagtgacaaagccaacaacaaccg

SEQ ID NO: 20774 - DNA, 24 bp, Homo sapiens
ccgtctgagatgcctgaccagttc

SEQ ID NO: 20775 - DNA, 24 bp, Homo sapiens
agccctgtgtccctgtcagagttt

SEQ ID NO: 20776 - DNA, 25 bp, Homo sapiens
tgtctgaagatgactcggaaaccca

SEQ ID NO: 20777 - DNA, 24 bp, Homo sapiens
ggcgaggcaggaaggtcatggagg

SEQ ID NO: 20778 - DNA, 24 bp, Homo sapiens
tggcgaggcaggaaggtcatggag

SEQ ID NO: 20779 - DNA, 24 bp, Homo sapiens
gtggcgaggcaggaaggtcatgga

SEQ ID NO: 20780 - DNA, 24 bp, Homo sapiens
atttggaaaaggtaaaacatgttt

SEQ ID NO: 20781 - DNA, 24 bp, Homo sapiens
gatttggaaaaggtaaaacatgtt

SEQ ID NO: 20782 - DNA, 24 bp, Homo sapiens
tgatttggaaaaggtaaaacatgt

SEQ ID NO: 20783 - DNA, 24 bp, Homo sapiens
aaatgcaggcagtaagaatacttt

SEQ ID NO: 20784 - DNA, 24 bp, Homo sapiens
gaaatgcaggcagtaagaatactt

SEQ ID NO: 20785 - DNA, 24 bp, Homo sapiens
tgaaatgcaggcagtaagaatact

SEQ ID NO: 20786 - DNA, 24 bp, Homo sapiens
agtgaatcaactccagagacaact

SEQ ID NO: 20787 - DNA, 24 bp, Homo sapiens
actgcgaacagagtctgatactgc

SEQ ID NO: 20788 - DNA, 24 bp, Homo sapiens
gcctgctggagactgccaagttaa

SEQ ID NO: 20789 - DNA, 24 bp, Homo sapiens
ggatgaacgggactctttggctgc

SEQ ID NO: 20790 - DNA, 24 bp, Homo sapiens
ggagatcaccttgaccaaagcaga

SEQ ID NO: 20791 - DNA, 24 bp, Homo sapiens
gatgttcaagagcaactgtcaaga

SEQ ID NO: 20792 - DNA, 24 bp, Homo sapiens
gatgttcaagagcaactgtcaaga

SEQ ID NO: 20793 - DNA, 24 bp, Homo sapiens
gctgtgaataagttggctgagatc

SEQ ID NO: 20794 - DNA, 24 bp, Homo sapiens
caagcgtggtaatgacacagatgt

SEQ ID NO: 20795 - DNA, 24 bp, Homo sapiens
ccaaccaactgtgaggcttgtatg

SEQ ID NO: 20796 - DNA, 24 bp, Homo sapiens
tgccgccgttgccatattaagtgt

SEQ ID NO: 20797 - DNA, 24 bp, Homo sapiens
tctacagaagagcagcagaagtgg

SEQ ID NO: 20798 - DNA, 24 bp, Homo sapiens
cttaactccaggcaactatccaaa

SEQ ID NO: 20799 - DNA, 24 bp, Homo sapiens
acttaactccaggcaactatccaa

SEQ ID NO: 20800 - DNA, 24 bp, Homo sapiens
gacttaactccaggcaactatcca

SEQ ID NO: 20801 - DNA, 24 bp, Homo sapiens
caccagtcggattcctcttgttcg

SEQ ID NO: 20802 - DNA, 24 bp, Homo sapiens
gccaattagacgagtccatacgag

SEQ ID NO: 20803 - DNA, 24 bp, Homo sapiens
cctcaatggaacagtcatgctgga

SEQ ID NO: 20804 - DNA, 24 bp, Homo sapiens
tggacctgtgtttcacgaagagag

SEQ ID NO: 20805 - DNA, 24 bp, Homo sapiens
cgttatgtgccgctctggaaggtc

SEQ ID NO: 20806 - DNA, 24 bp, Homo sapiens
gcttgatgatcttatgccagaaag

SEQ ID NO: 20807 - DNA, 24 bp, Homo sapiens
tttgcgaacaggtctgtctgcctc

SEQ ID NO: 20808 - DNA, 24 bp, Homo sapiens
ctttgcgaacaggtctgtctgcct

SEQ ID NO: 20809 - DNA, 24 bp, Homo sapiens
tctttgcgaacaggtctgtctgcc

SEQ ID NO: 20810 - DNA, 24 bp, Homo sapiens
tcaagtaactgtcctacctccagg

SEQ ID NO: 20811 - DNA, 24 bp, Homo sapiens
ggcaaggcaccacagtaccatgaa

SEQ ID NO: 20812 - DNA, 24 bp, Homo sapiens
actggctcctgctgtcctccttac

SEQ ID NO: 20813 - DNA, 24 bp, Homo sapiens
caccagtcggattcctcttgttcg

SEQ ID NO: 20814 - DNA, 24 bp, Homo sapiens
taggcaagaaacattctgaccctc

SEQ ID NO: 20815 - DNA, 24 bp, Homo sapiens
agagacatcatcatcagaatgaga

SEQ ID NO: 20816 - DNA, 24 bp, Homo sapiens
gtctgtctgcctcaaacctttcct

SEQ ID NO: 20817 - DNA, 24 bp, Homo sapiens
cagccgcctgacctccagaagttc

SEQ ID NO: 20818 - DNA, 24 bp, Homo sapiens
ccgcctgaggaagacttagaagca

SEQ ID NO: 20819 - DNA, 24 bp, Homo sapiens
ggcaaggcaccacagtaccatgaa

SEQ ID NO: 20820 - DNA, 24 bp, Homo sapiens
actggctcctgctgtcctccttac

SEQ ID NO: 20821 - DNA, 24 bp, Homo sapiens
ggtaatggaagtggtggaagcaga

SEQ ID NO: 20822 - DNA, 24 bp, Homo sapiens
tcccagcaatgaaactctagcaca

SEQ ID NO: 20823 - DNA, 24 bp, Homo sapiens
ggtcagcttgtggtcatcatggac

SEQ ID NO: 20824 - DNA, 24 bp, Homo sapiens
agaccaagcgttactttcctacca

SEQ ID NO: 20825 - DNA, 24 bp, Homo sapiens
ttctgtcttcattcctcaagcaat

SEQ ID NO: 20826 - DNA, 24 bp, Homo sapiens
ggtcagcttgtggtcatcatggac

SEQ ID NO: 20827 - DNA, 24 bp, Homo sapiens
tgaacctccaaatcccagcaatga

SEQ ID NO: 20828 - DNA, 24 bp, Homo sapiens
ttgtaatgagcaccgtggagacta

SEQ ID NO: 20829 - DNA, 24 bp, Homo sapiens
ctctgttcatcagtggcaattcgt

SEQ ID NO: 20830 - DNA, 24 bp, Homo sapiens
catgctgtttatgtgtgactaccg

SEQ ID NO: 20831 - DNA, 24 bp, Homo sapiens
cagaagtggctgcacaacaacctt

SEQ ID NO: 20832 - DNA, 24 bp, Homo sapiens
atgacgctctcgatattcctgtgc

SEQ ID NO: 20833 - DNA, 24 bp, Homo sapiens
cacttccctgctgcctgtaaatat

SEQ ID NO: 20834 - DNA, 24 bp, Homo sapiens
gcaccatccgcacctccatcctat

SEQ ID NO: 20835 - DNA, 24 bp, Homo sapiens
ccttcgtattatacccagccagcg

SEQ ID NO: 20836 - DNA, 24 bp, Homo sapiens
cagttattaccccacacctccagc

SEQ ID NO: 20837 - DNA, 24 bp, Homo sapiens
gcaacaagatgatcgtgagtcagc

SEQ ID NO: 20838 - DNA, 24 bp, Homo sapiens
gtgctctgacctggctgtcctgcg

SEQ ID NO: 20839 - DNA, 24 bp, Homo sapiens
tctcctgggcacctacaagcgttt

SEQ ID NO: 20840 - DNA, 24 bp, Homo sapiens
ccgccggccagatccatcatgtta

SEQ ID NO: 20841 - DNA, 24 bp, Homo sapiens
gccgccggccagatccatcatgtt

SEQ ID NO: 20842 - DNA, 24 bp, Homo sapiens
cgccgccggccagatccatcatgt

SEQ ID NO: 20843 - DNA, 24 bp, Homo sapiens
caagtgattctcgtgcctcagcct

SEQ ID NO: 20844 - DNA, 24 bp, Homo sapiens
aggctggaatgcaatggcgtaatc

SEQ ID NO: 20845 - DNA, 24 bp, Homo sapiens
ctcactgcaacctccgcctcctgg

SEQ ID NO: 20846 - DNA, 24 bp, Homo sapiens
gccgagtgtcctaccctttgtgtt

SEQ ID NO: 20847 - DNA, 24 bp, Homo sapiens
gccgagtgtcctaccctttgtgtt

SEQ ID NO: 20848 - DNA, 24 bp, Homo sapiens
atccgcaccactgatgacctcact

SEQ ID NO: 20849 - DNA, 24 bp, Homo sapiens
tctttcgttgatctctgggctggg

SEQ ID NO: 20850 - DNA, 23 bp, Homo sapiens
atgtatgaagccccaccaggagc

SEQ ID NO: 20851 - DNA, 23 bp, Homo sapiens
ccgttctcctgcctcagccttct

SEQ ID NO: 20852 - DNA, 24 bp, Homo sapiens
ctccgccttccaggttcaagcaat

SEQ ID NO: 20853 - DNA, 23 bp, Homo sapiens
gcagtggcacaatcttggctcac

SEQ ID NO: 20854 - DNA, 24 bp, Homo sapiens
tttgtttgatggtggagttggcat

SEQ ID NO: 20855 - DNA, 24 bp, Homo sapiens
atttgtttgatggtggagttggca

SEQ ID NO: 20856 - DNA, 24 bp, Homo sapiens
tatttgtttgatggtggagttggc

SEQ ID NO: 20857 - DNA, 24 bp, Homo sapiens
ggctagtcttgaactcctgacctc

SEQ ID NO: 20858 - DNA, 24 bp, Homo sapiens
atccacccacctcagcctcccaga

SEQ ID NO: 20859 - DNA, 24 bp, Homo sapiens
gggattataagcatgagccaccgt

SEQ ID NO: 20860 - DNA, 24 bp, Homo sapiens
tccagcctcagcctaagcccagca

SEQ ID NO: 20861 - DNA, 24 bp, Homo sapiens
ctccagcctcagcctaagcccagc

SEQ ID NO: 20862 - DNA, 24 bp, Homo sapiens
tctccagcctcagcctaagcccag

SEQ ID NO: 20863 - DNA, 25 bp, Homo sapiens
tgtctgcctgcgtatctgtctctga

SEQ ID NO: 20864 - DNA, 23 bp, Homo sapiens
cctatcttgctgctcctcttggc

SEQ ID NO: 20865 - DNA, 25 bp, Homo sapiens
ttctgggatttggtgtctgctgctg

SEQ ID NO: 20866 - DNA, 24 bp, Homo sapiens
cctgcctctgggcttccttggtga

SEQ ID NO: 20867 - DNA, 24 bp, Homo sapiens
gcctgcctctgggcttccttggtg

SEQ ID NO: 20868 - DNA, 24 bp, Homo sapiens
agcctgcctctgggcttccttggt

SEQ ID NO: 20869 - DNA, 24 bp, Homo sapiens
gcatctcccaggtgatgtccttgc

SEQ ID NO: 20870 - DNA, 24 bp, Homo sapiens
ggcatctcccaggtgatgtccttg

SEQ ID NO: 20871 - DNA, 24 bp, Homo sapiens
tggcatctcccaggtgatgtcctt

SEQ ID NO: 20872 - DNA, 25 bp, Homo sapiens
acgatggacagtgaagatggctacc

SEQ ID NO: 20873 - DNA, 25 bp, Homo sapiens
cggcagacgagtacagatgatgagt

SEQ ID NO: 20874 - DNA, 25 bp, Homo sapiens
tctgaggaggtcatcttcaaggagg

SEQ ID NO: 20875 - DNA, 24 bp, Homo sapiens
aatgacaacgcgtaagaataacga

SEQ ID NO: 20876 - DNA, 24 bp, Homo sapiens
caatgacaacgcgtaagaataacg

SEQ ID NO: 20877 - DNA, 24 bp, Homo sapiens
tcaatgacaacgcgtaagaataac

SEQ ID NO: 20878 - DNA, 24 bp, Homo sapiens
tgaatcagatggacactcacatgg

SEQ ID NO: 20879 - DNA, 24 bp, Homo sapiens
ctgaatcagatggacactcacatg

SEQ ID NO: 20880 - DNA, 24 bp, Homo sapiens
tctgaatcagatggacactcacat

SEQ ID NO: 20881 - DNA, 23 bp, Homo sapiens
tcacagacctgcccaatgccttt

SEQ ID NO: 20882 - DNA, 23 bp, Homo sapiens
gaagcacaccctcccctcattca

SEQ ID NO: 20883 - DNA, 23 bp, Homo sapiens
ccactgcttatgaaggaaactgg

SEQ ID NO: 20884 - DNA, 23 bp, Homo sapiens
gcatcatgaggaagaagagaccc

SEQ ID NO: 20885 - DNA, 23 bp, Homo sapiens
agtggcaatggagctgtggagga

SEQ ID NO: 20886 - DNA, 23 bp, Homo sapiens
gccaagtggactcaacggagagg

SEQ ID NO: 20887 - DNA, 24 bp, Homo sapiens
ttggtgaacaaggagtcgtcagaa

SEQ ID NO: 20888 - DNA, 24 bp, Homo sapiens
gaggctggccctattagtgatttc

SEQ ID NO: 20889 - DNA, 24 bp, Homo sapiens
agaggctggccctattagtgattt

SEQ ID NO: 20890 - DNA, 24 bp, Homo sapiens
tagaggctggccctattagtgatt

SEQ ID NO: 20891 - DNA, 25 bp, Homo sapiens
gccacctgttctctcctgtgaaagg

SEQ ID NO: 20892 - DNA, 25 bp, Homo sapiens
ggaaatgaaagagattggcaaaggg

SEQ ID NO: 20893 - DNA, 25 bp, Homo sapiens
tgatgccatgtagatcctgtttgac

SEQ ID NO: 20894 - DNA, 23 bp, Homo sapiens
atcatcttggcatccctcttggc

SEQ ID NO: 20895 - DNA, 24 bp, Homo sapiens
cgaagaaggtgtgggcagaagaaa

SEQ ID NO: 20896 - DNA, 23 bp, Homo sapiens
agtggcaatggagctgtggagga

SEQ ID NO: 20897 - DNA, 24 bp, Homo sapiens
cgaagaaggtgtgggcagaagaaa

SEQ ID NO: 20898 - DNA, 23 bp, Homo sapiens
gtggcaatggagctgtggaggac

SEQ ID NO: 20899 - DNA, 23 bp, Homo sapiens
ccaagtggactcaacggagaggc

SEQ ID NO: 20900 - DNA, 24 bp, Homo sapiens
agcccccggggacgttcctcgtgc

SEQ ID NO: 20901 - DNA, 24 bp, Homo sapiens
gagcccccggggacgttcctcgtg

SEQ ID NO: 20902 - DNA, 24 bp, Homo sapiens
cgagcccccggggacgttcctcgt

SEQ ID NO: 20903 - DNA, 24 bp, Homo sapiens
ttctctcctagatgatcctaccag

SEQ ID NO: 20904 - DNA, 24 bp, Homo sapiens
gttctctcctagatgatcctacca

SEQ ID NO: 20905 - DNA, 24 bp, Homo sapiens
tgttctctcctagatgatcctacc

SEQ ID NO: 20906 - DNA, 24 bp, Homo sapiens
cgcatgatgaaaaaccaggtgatg

SEQ ID NO: 20907 - DNA, 24 bp, Homo sapiens
gcgcatgatgaaaaaccaggtgat

SEQ ID NO: 20908 - DNA, 24 bp, Homo sapiens
ggcgcatgatgaaaaaccaggtga

SEQ ID NO: 20909 - DNA, 23 bp, Homo sapiens
cagaagtggtccagagcacacgg

SEQ ID NO: 20910 - DNA, 25 bp, Homo sapiens
agtcctcccatacgagcatttgaag

SEQ ID NO: 20911 - DNA, 24 bp, Homo sapiens
ggcatcaccaccatcaaagaaatg

SEQ ID NO: 20912 - DNA, 25 bp, Homo sapiens
gcgatgctattgaggtgataagtcc

SEQ ID NO: 20913 - DNA, 23 bp, Homo sapiens
aattgcctcggacaaggatgcga

SEQ ID NO: 20914 - DNA, 25 bp, Homo sapiens
gctaaggaccagagggaagactacc

SEQ ID NO: 20915 - DNA, 24 bp, Homo sapiens
tgcctgcccagctgaatgagtatg

SEQ ID NO: 20916 - DNA, 24 bp, Homo sapiens
gtgcctgcccagctgaatgagtat

SEQ ID NO: 20917 - DNA, 24 bp, Homo sapiens
tgtgcctgcccagctgaatgagta

SEQ ID NO: 20918 - DNA, 24 bp, Homo sapiens
agattgttatgttccactggtgaa

SEQ ID NO: 20919 - DNA, 24 bp, Homo sapiens
cagattgttatgttccactggtga

SEQ ID NO: 20920 - DNA, 24 bp, Homo sapiens
gcagattgttatgttccactggtg

SEQ ID NO: 20921 - DNA, 24 bp, Homo sapiens
agcttattgacgtgctggtaaaca

SEQ ID NO: 20922 - DNA, 24 bp, Homo sapiens
gagcttattgacgtgctggtaaac

SEQ ID NO: 20923 - DNA, 24 bp, Homo sapiens
tgagcttattgacgtgctggtaaa

SEQ ID NO: 20924 - DNA, 25 bp, Homo sapiens
tggatctcttcaggcacactacaga

SEQ ID NO: 20925 - DNA, 25 bp, Homo sapiens
attaggttatgcgtattgggtctgc

SEQ ID NO: 20926 - DNA, 25 bp, Homo sapiens
tcctccagatgaatgctattccagc

SEQ ID NO: 20927 - DNA, 25 bp, Homo sapiens
tcagaggtgccttcttacatcagcg

SEQ ID NO: 20928 - DNA, 24 bp, Homo sapiens
agaaagccttcaagccctgtgtgc

SEQ ID NO: 20929 - DNA, 25 bp, Homo sapiens
gcagcacttaatgagttactgaagc

SEQ ID NO: 20930 - DNA, 25 bp, Homo sapiens
ggaaagagtggtatatcagcctggg

SEQ ID NO: 20931 - DNA, 25 bp, Homo sapiens
acctactgagacacttatatgccaa

SEQ ID NO: 20932 - DNA, 25 bp, Homo sapiens
tggagatacaagagcattggaactg

SEQ ID NO: 20933 - DNA, 24 bp, Homo sapiens
tcccttccttccacccatcgtcag

SEQ ID NO: 20934 - DNA, 24 bp, Homo sapiens
acctctcccgatctgctgtttcct

SEQ ID NO: 20935 - DNA, 24 bp, Homo sapiens
aaagggtttggttgtctacactgc

SEQ ID NO: 20936 - DNA, 24 bp, Homo sapiens
acttgacggttcaggttactttgc

SEQ ID NO: 20937 - DNA, 24 bp, Homo sapiens
cctttaatactggcgagagcaaca

SEQ ID NO: 20938 - DNA, 24 bp, Homo sapiens
cctaaagtgtgggtttcctgttct

SEQ ID NO: 20939 - DNA, 24 bp, Homo sapiens
tgggattacaggtgagtgccacca

SEQ ID NO: 20940 - DNA, 24 bp, Homo sapiens
ctgggattacaggtgagtgccacc

SEQ ID NO: 20941 - DNA, 24 bp, Homo sapiens
gctgggattacaggtgagtgccac

SEQ ID NO: 20942 - DNA, 23 bp, Homo sapiens
cttctccgcctgaccgacgactc

SEQ ID NO: 20943 - DNA, 25 bp, Homo sapiens
ccgttatcctccaatctgctgatct

SEQ ID NO: 20944 - DNA, 24 bp, Homo sapiens
cgccctcaagagccttctgaaatt

SEQ ID NO: 20945 - DNA, 23 bp, Homo sapiens
cttctccgcctgaccgacgactc

SEQ ID NO: 20946 - DNA, 23 bp, Homo sapiens
agaccagaccccgttatcctcca

SEQ ID NO: 20947 - DNA, 23 bp, Homo sapiens
cctgtcccctcgtgcctgccgtc

SEQ ID NO: 20948 - DNA, 24 bp, Homo sapiens
gcatccaggcaagtcagtcctctg

SEQ ID NO: 20949 - DNA, 24 bp, Homo sapiens
acctcagtgcccgaagtgttacca

SEQ ID NO: 20950 - DNA, 23 bp, Homo sapiens
actcacggtaactcaagtgctgc

SEQ ID NO: 20951 - DNA, 23 bp, Homo sapiens
gaatcgcacacagcctcggaact

SEQ ID NO: 20952 - DNA, 23 bp, Homo sapiens
cttctccgcctgaccgacgactc

SEQ ID NO: 20953 - DNA, 25 bp, Homo sapiens
ccgttatcctccaatctgctgatct

SEQ ID NO: 20954 - DNA, 25 bp, Homo sapiens
gctgttgtgcaaagaatccgtgaga

SEQ ID NO: 20955 - DNA, 25 bp, Homo sapiens
ttgaaaactgctccgttccctctgg

SEQ ID NO: 20956 - DNA, 25 bp, Homo sapiens
aggccacagagaagcagaattcatc

SEQ ID NO: 20957 - DNA, 23 bp, Homo sapiens
actcacggtaactcaagtgctgc

SEQ ID NO: 20958 - DNA, 23 bp, Homo sapiens
aacagtgagcaccagcaaggtca

SEQ ID NO: 20959 - DNA, 23 bp, Homo sapiens
ggagctgtgccgcatggagtcaa

SEQ ID NO: 20960 - DNA, 24 bp, Homo sapiens
tgggaattgtctttgcctgctgcc

SEQ ID NO: 20961 - DNA, 24 bp, Homo sapiens
tcatgttggtggaggtggccgcag

SEQ ID NO: 20962 - DNA, 24 bp, Homo sapiens
atcatgttggtggaggtggccgca

SEQ ID NO: 20963 - DNA, 24 bp, Homo sapiens
tatcatgttggtggaggtggccgc

SEQ ID NO: 20964 - DNA, 24 bp, Homo sapiens
gttccagtgtgctgtgctggccct

SEQ ID NO: 20965 - DNA, 24 bp, Homo sapiens
tgttccagtgtgctgtgctggccc

SEQ ID NO: 20966 - DNA, 24 bp, Homo sapiens
gtgttccagtgtgctgtgctggcc

SEQ ID NO: 20967 - DNA, 24 bp, Homo sapiens
gaaacgtcacagttcatccaacaa

SEQ ID NO: 20968 - DNA, 24 bp, Homo sapiens
ggaaacgtcacagttcatccaaca

SEQ ID NO: 20969 - DNA, 24 bp, Homo sapiens
tggaaacgtcacagttcatccaac

SEQ ID NO: 20970 - DNA, 24 bp, Homo sapiens
cattgttcaagctccataatcgga

SEQ ID NO: 20971 - DNA, 24 bp, Homo sapiens
ccattgttcaagctccataatcgg

SEQ ID NO: 20972 - DNA, 24 bp, Homo sapiens
cccattgttcaagctccataatcg

SEQ ID NO: 20973 - DNA, 24 bp, Homo sapiens
cccttcccaagtaacagcaacaag

SEQ ID NO: 20974 - DNA, 24 bp, Homo sapiens
tcccttcccaagtaacagcaacaa

SEQ ID NO: 20975 - DNA, 24 bp, Homo sapiens
ttcccttcccaagtaacagcaaca

SEQ ID NO: 20976 - DNA, 24 bp, Homo sapiens
gcccccgacaggtcactcagctct

SEQ ID NO: 20977 - DNA, 24 bp, Homo sapiens
tgcccccgacaggtcactcagctc

SEQ ID NO: 20978 - DNA, 24 bp, Homo sapiens
ttgcccccgacaggtcactcagct

SEQ ID NO: 20979 - DNA, 24 bp, Homo sapiens
cttaaacctgggaggactcacgaa

SEQ ID NO: 20980 - DNA, 24 bp, Homo sapiens
gcttaaacctgggaggactcacga

SEQ ID NO: 20981 - DNA, 24 bp, Homo sapiens
agcttaaacctgggaggactcacg

SEQ ID NO: 20982 - DNA, 24 bp, Homo sapiens
aaagattttaggtttgtatgtttt

SEQ ID NO: 20983 - DNA, 24 bp, Homo sapiens
caaagattttaggtttgtatgttt

SEQ ID NO: 20984 - DNA, 24 bp, Homo sapiens
tcaaagattttaggtttgtatgtt

SEQ ID NO: 20985 - DNA, 24 bp, Homo sapiens
agcgacactaggtgagacattctg

SEQ ID NO: 20986 - DNA, 24 bp, Homo sapiens
cagcgacactaggtgagacattct

SEQ ID NO: 20987 - DNA, 24 bp, Homo sapiens
gcagcgacactaggtgagacattc

SEQ ID NO: 20988 - DNA, 24 bp, Homo sapiens
ccagcagcagcccaataacaacct

SEQ ID NO: 20989 - DNA, 25 bp, Homo sapiens
acggcaacaactctctgaacagcaa

SEQ ID NO: 20990 - DNA, 23 bp, Homo sapiens
cggaagtagcagttctctcggcg

SEQ ID NO: 20991 - DNA, 25 bp, Homo sapiens
ttcagagaatcctggagcactgtct

SEQ ID NO: 20992 - DNA, 23 bp, Homo sapiens
tactggagcacggtcgtcctgag

SEQ ID NO: 20993 - DNA, 24 bp, Homo sapiens
tgtagcagaaatccgaggcaatgt

SEQ ID NO: 20994 - DNA, 24 bp, Homo sapiens
cttaaacctgggagcaggcttttg

SEQ ID NO: 20995 - DNA, 24 bp, Homo sapiens
gcttaaacctgggagcaggctttt

SEQ ID NO: 20996 - DNA, 24 bp, Homo sapiens
agcttaaacctgggagcaggcttt

SEQ ID NO: 20997 - DNA, 24 bp, Homo sapiens
gctggtggtcttgctggaacaaca

SEQ ID NO: 20998 - DNA, 23 bp, Homo sapiens
ttaggaacacagcagcctcagcc

SEQ ID NO: 20999 - DNA, 24 bp, Homo sapiens
ccagcagcagcccaataacaacct

SEQ ID NO: 21000 - DNA, 23 bp, Homo sapiens
ccagcagggacagcaaacggatc

SEQ ID NO: 21001 - DNA, 24 bp, Homo sapiens
aattctgcccttgcatttggacaa

SEQ ID NO: 21002 - DNA, 23 bp, Homo sapiens
agccaacgtcctttgaccccaaa

SEQ ID NO: 21003 - DNA, 24 bp, Homo sapiens
accaagcccagctggagaaacaga

SEQ ID NO: 21004 - DNA, 24 bp, Homo sapiens
taccaagcccagctggagaaacag

SEQ ID NO: 21005 - DNA, 24 bp, Homo sapiens
ataccaagcccagctggagaaaca

SEQ ID NO: 21006 - DNA, 24 bp, Homo sapiens
caacagcagaggtaatcgagccta

SEQ ID NO: 21007 - DNA, 24 bp, Homo sapiens
gcaacagcagaggtaatcgagcct

SEQ ID NO: 21008 - DNA, 24 bp, Homo sapiens
agcaacagcagaggtaatcgagcc

SEQ ID NO: 21009 - DNA, 24 bp, Homo sapiens
caaatgagctttgatcaccagcag

SEQ ID NO: 21010 - DNA, 24 bp, Homo sapiens
gcaaatgagctttgatcaccagca

SEQ ID NO: 21011 - DNA, 24 bp, Homo sapiens
ggcaaatgagctttgatcaccagc

SEQ ID NO: 21012 - DNA, 25 bp, Homo sapiens
ggtctaatggaagcatggttcggca

SEQ ID NO: 21013 - DNA, 25 bp, Homo sapiens
gtaagcctacacttgcctatccaga

SEQ ID NO: 21014 - DNA, 25 bp, Homo sapiens
cgacgcttggaacttgagaggattc

SEQ ID NO: 21015 - DNA, 24 bp, Homo sapiens
tcagctacaagggtgagaagaaca

SEQ ID NO: 21016 - DNA, 24 bp, Homo sapiens
gtcagctacaagggtgagaagaac

SEQ ID NO: 21017 - DNA, 24 bp, Homo sapiens
tgtcagctacaagggtgagaagaa

SEQ ID NO: 21018 - DNA, 24 bp, Homo sapiens
tcctttcccaggctaatctgtgag

SEQ ID NO: 21019 - DNA, 24 bp, Homo sapiens
ttcctttcccaggctaatctgtga

SEQ ID NO: 21020 - DNA, 24 bp, Homo sapiens
tttcctttcccaggctaatctgtg

SEQ ID NO: 21021 - DNA, 25 bp, Homo sapiens
gacctcaggactttgtgttcatgtt

SEQ ID NO: 21022 - DNA, 24 bp, Homo sapiens
tcaacgccaaggtgtgtctgcctc

SEQ ID NO: 21023 - DNA, 24 bp, Homo sapiens
atcaacgccaaggtgtgtctgcct

SEQ ID NO: 21024 - DNA, 24 bp, Homo sapiens
aatcaacgccaaggtgtgtctgcc

SEQ ID NO: 21025 - DNA, 25 bp, Homo sapiens
ccaacaataacttacaggaaggcac

SEQ ID NO: 21026 - DNA, 25 bp, Homo sapiens
ggatgtactagatggcgagcagacc

SEQ ID NO: 21027 - DNA, 25 bp, Homo sapiens
tgagcacagcatggcttgtcttcaa

SEQ ID NO: 21028 - DNA, 24 bp, Homo sapiens
tttccatttagaccgaggccggtt

SEQ ID NO: 21029 - DNA, 24 bp, Homo sapiens
gtttccatttagaccgaggccggt

SEQ ID NO: 21030 - DNA, 24 bp, Homo sapiens
ggtttccatttagaccgaggccgg

SEQ ID NO: 21031 - DNA, 25 bp, Homo sapiens
ggatgtactagatggcgagcagacc

SEQ ID NO: 21032 - DNA, 25 bp, Homo sapiens
tgagcacagcatggcttgtcttcaa

SEQ ID NO: 21033 - DNA, 23 bp, Homo sapiens
ttgtgctgtagctgttggaggct

SEQ ID NO: 21034 - DNA, 24 bp, Homo sapiens
gctgacctgccttctggaaatgga

SEQ ID NO: 21035 - DNA, 25 bp, Homo sapiens
tccagcagcagcacaaattattcca

SEQ ID NO: 21036 - DNA, 23 bp, Homo sapiens
gctggatgttccgaagagaaggc

SEQ ID NO: 21037 - DNA, 24 bp, Homo sapiens
tgaaatccaagatgctgacatcag

SEQ ID NO: 21038 - DNA, 24 bp, Homo sapiens
ttgaaatccaagatgctgacatca

SEQ ID NO: 21039 - DNA, 24 bp, Homo sapiens
tttgaaatccaagatgctgacatc

SEQ ID NO: 21040 - DNA, 24 bp, Homo sapiens
tttccatgtagatgctgacatcag

SEQ ID NO: 21041 - DNA, 24 bp, Homo sapiens
gtttccatgtagatgctgacatca

SEQ ID NO: 21042 - DNA, 24 bp, Homo sapiens
ggtttccatgtagatgctgacatc

SEQ ID NO: 21043 - DNA, 24 bp, Homo sapiens
tctaccggcaggaggccccaggaa

SEQ ID NO: 21044 - DNA, 24 bp, Homo sapiens
gtctaccggcaggaggccccagga

SEQ ID NO: 21045 - DNA, 24 bp, Homo sapiens
tgtctaccggcaggaggccccagg

SEQ ID NO: 21046 - DNA, 24 bp, Homo sapiens
aggcatgttccgaagaccatcaga

SEQ ID NO: 21047 - DNA, 24 bp, Homo sapiens
ccacttcagcatctcagagtcctt

SEQ ID NO: 21048 - DNA, 24 bp, Homo sapiens
agaggaggaggaagtggaagagga

SEQ ID NO: 21049 - DNA, 25 bp, Homo sapiens
tctctgactctggctctgctgatga

SEQ ID NO: 21050 - DNA, 25 bp, Homo sapiens
agaggaggaggaagtggaagaggaa

SEQ ID NO: 21051 - DNA, 23 bp, Homo sapiens
tctctgagcaagacttcggcagc

SEQ ID NO: 21052 - DNA, 24 bp, Homo sapiens
ctctgactctggctctgctgatga

SEQ ID NO: 21053 - DNA, 24 bp, Homo sapiens
agaggaggaggaagtggaagagga

SEQ ID NO: 21054 - DNA, 24 bp, Homo sapiens
ccacttcagcatctcagagtcctt

SEQ ID NO: 21055 - DNA, 24 bp, Homo sapiens
cagtgctgatggtgccagtgaacg

SEQ ID NO: 21056 - DNA, 24 bp, Homo sapiens
ctgccttcctgctaagtgacgctc

SEQ ID NO: 21057 - DNA, 24 bp, Homo sapiens
tggaagcagtggaacagaacaacc

SEQ ID NO: 21058 - DNA, 24 bp, Homo sapiens
agtaccactgcctctcagcccagc

SEQ ID NO: 21059 - DNA, 24 bp, Homo sapiens
cagagcagtgctgatggtgccagt

SEQ ID NO: 21060 - DNA, 24 bp, Homo sapiens
ccctgctcggggatagacagtata

SEQ ID NO: 21061 - DNA, 24 bp, Homo sapiens
tctctgactctggctctgctgatg

SEQ ID NO: 21062 - DNA, 24 bp, Homo sapiens
gaaggaacacagcctcaagcagca

SEQ ID NO: 21063 - DNA, 24 bp, Homo sapiens
tcgtttcctcccagtccttctccc

SEQ ID NO: 21064 - DNA, 24 bp, Homo sapiens
tctctgactctggctctgctgatg

SEQ ID NO: 21065 - DNA, 24 bp, Homo sapiens
agaggaggaggaagtggaagagga

SEQ ID NO: 21066 - DNA, 24 bp, Homo sapiens
ccacttcagcatctcagagtcctt

SEQ ID NO: 21067 - DNA, 24 bp, Homo sapiens
gcttcccaagcgtgcgtgcacccc

SEQ ID NO: 21068 - DNA, 24 bp, Homo sapiens
agcttcccaagcgtgcgtgcaccc

SEQ ID NO: 21069 - DNA, 24 bp, Homo sapiens
aagcttcccaagcgtgcgtgcacc

SEQ ID NO: 21070 - DNA, 24 bp, Homo sapiens
tctgggcccagtccccatgtgaga

SEQ ID NO: 21071 - DNA, 24 bp, Homo sapiens
atctgggcccagtccccatgtgag

SEQ ID NO: 21072 - DNA, 24 bp, Homo sapiens
gatctgggcccagtccccatgtga

SEQ ID NO: 21073 - DNA, 24 bp, Homo sapiens
tccaccgaaagagtcactggaact

SEQ ID NO: 21074 - DNA, 24 bp, Homo sapiens
ctccaccgaaagagtcactggaac

SEQ ID NO: 21075 - DNA, 24 bp, Homo sapiens
gctccaccgaaagagtcactggaa

SEQ ID NO: 21076 - DNA, 23 bp, Homo sapiens
ccgtcttctgggctgggtgtgac

SEQ ID NO: 21077 - DNA, 23 bp, Homo sapiens
cggtcttcaacatcctgccagcc

SEQ ID NO: 21078 - DNA, 25 bp, Homo sapiens
cccatctcccaccctgtacctcatc

SEQ ID NO: 21079 - DNA, 24 bp, Homo sapiens
tttcttgctcccttcagcccccag

SEQ ID NO: 21080 - DNA, 24 bp, Homo sapiens
ctttcttgctcccttcagccccca

SEQ ID NO: 21081 - DNA, 24 bp, Homo sapiens
gctttcttgctcccttcagccccc

SEQ ID NO: 21082 - DNA, 23 bp, Homo sapiens
cccatgtgagagcagcagaggcg

SEQ ID NO: 21083 - DNA, 23 bp, Homo sapiens
gtgtgaccaagcaggatctgggc

SEQ ID NO: 21084 - DNA, 23 bp, Homo sapiens
cactggaactggaggacccgtct

SEQ ID NO: 21085 - DNA, 25 bp, Homo sapiens
ttgaaatgagcaggcactccttgga

SEQ ID NO: 21086 - DNA, 23 bp, Homo sapiens
gcccactgacgctccaccgaaag

SEQ ID NO: 21087 - DNA, 23 bp, Homo sapiens
ccgtcttctgggctgggtgtgac

SEQ ID NO: 21088 - DNA, 25 bp, Homo sapiens
cggagaacctgagacaccttaagaa

SEQ ID NO: 21089 - DNA, 24 bp, Homo sapiens
gcaccattggctcctgtttgaaat

SEQ ID NO: 21090 - DNA, 23 bp, Homo sapiens
gcccactgacgctccaccgaaag

SEQ ID NO: 21091 - DNA, 24 bp, Homo sapiens
gcttcccaagcctcccaaagtgct

SEQ ID NO: 21092 - DNA, 24 bp, Homo sapiens
agcttcccaagcctcccaaagtgc

SEQ ID NO: 21093 - DNA, 24 bp, Homo sapiens
aagcttcccaagcctcccaaagtg

SEQ ID NO: 21094 - DNA, 24 bp, Homo sapiens
atgcgctgaataacccgatcatca

SEQ ID NO: 21095 - DNA, 24 bp, Homo sapiens
catgcgctgaataacccgatcatc

SEQ ID NO: 21096 - DNA, 24 bp, Homo sapiens
ccatgcgctgaataacccgatcat

SEQ ID NO: 21097 - DNA, 24 bp, Homo sapiens
ccgcgtgcgccgtgagtggcccag

SEQ ID NO: 21098 - DNA, 24 bp, Homo sapiens
tccgcgtgcgccgtgagtggccca

SEQ ID NO: 21099 - DNA, 24 bp, Homo sapiens
tccgcgtgcgccgtgagtggccca

SEQ ID NO: 21100 - DNA, 25 bp, Homo sapiens
ccaagaaccgaatcatcacagccga

SEQ ID NO: 21101 - DNA, 23 bp, Homo sapiens
gcctgaacctggacgactgctcc

SEQ ID NO: 21102 - DNA, 23 bp, Homo sapiens
ggtaacctcactcttctccaggc

SEQ ID NO: 21103 - DNA, 25 bp, Homo sapiens
ccaagaaccgaatcatcacagccga

SEQ ID NO: 21104 - DNA, 24 bp, Homo sapiens
ggcaacgagtcataccagcagtcc

SEQ ID NO: 21105 - DNA, 25 bp, Homo sapiens
tcatccagaatgtgaacaagagcca

SEQ ID NO: 21106 - DNA, 25 bp, Homo sapiens
gcagcctcaacataggagatgtcca

SEQ ID NO: 21107 - DNA, 25 bp, Homo sapiens
gacattctcctttcagcccttctgg

SEQ ID NO: 21108 - DNA, 23 bp, Homo sapiens
ggtaacctcactcttctccaggc

SEQ ID NO: 21109 - DNA, 25 bp, Homo sapiens
tctctgaatgagtgaggagccatca

SEQ ID NO: 21110 - DNA, 25 bp, Homo sapiens
gcagatgaggaggtggaactgatcc

SEQ ID NO: 21111 - DNA, 23 bp, Homo sapiens
agttgctggaggcggagttggag

SEQ ID NO: 21112 - DNA, 23 bp, Homo sapiens
agttgctggaggcggagttggag

SEQ ID NO: 21113 - DNA, 25 bp, Homo sapiens
tgaagatgatgatgacaccgatgat

SEQ ID NO: 21114 - DNA, 25 bp, Homo sapiens
acaatgacttctctccctctgatga

SEQ ID NO: 21115 - DNA, 23 bp, Homo sapiens
aaaggaacatggcagtgggcagg

SEQ ID NO: 21116 - DNA, 25 bp, Homo sapiens
gccacttgctgagaatactcttcaa

SEQ ID NO: 21117 - DNA, 24 bp, Homo sapiens
atatgtgatgacaagccgagagcc

SEQ ID NO: 21118 - DNA, 24 bp, Homo sapiens
atatgtgatgacaagccgagagcc

SEQ ID NO: 21119 - DNA, 24 bp, Homo sapiens
gggctggaaactgctgtcgtcttt

SEQ ID NO: 21120 - DNA, 25 bp, Homo sapiens
actggactgttaggaggtgctatgg

SEQ ID NO: 21121 - DNA, 25 bp, Homo sapiens
tggcagaggatgaggatgaagagga

SEQ ID NO: 21122 - DNA, 25 bp, Homo sapiens
ggaagaggaagaacaggaggaagaa

SEQ ID NO: 21123 - DNA, 23 bp, Homo sapiens
agttgctggaggcggagttggag

SEQ ID NO: 21124 - DNA, 25 bp, Homo sapiens
tgaagatgatgatgacaccgatgat

SEQ ID NO: 21125 - DNA, 23 bp, Homo sapiens
agttgctggaggcggagttggag

SEQ ID NO: 21126 - DNA, 25 bp, Homo sapiens
gcagatgaggaggtggaactgatcc

SEQ ID NO: 21127 - DNA, 23 bp, Homo sapiens
agagtccctgccctacgatgagc

SEQ ID NO: 21128 - DNA, 24 bp, Homo sapiens
gtagacccgttactccctgccaca

SEQ ID NO: 21129 - DNA, 25 bp, Homo sapiens
aagccaatgccctcactaccacaac

SEQ ID NO: 21130 - DNA, 24 bp, Homo sapiens
gctaggattgaggctcgactgtgc

SEQ ID NO: 21131 - DNA, 25 bp, Homo sapiens
ctcgggaactctgggatagcatcat

SEQ ID NO: 21132 - DNA, 24 bp, Homo sapiens
cgtctgcgaagtgttactcaccat

SEQ ID NO: 21133 - DNA, 24 bp, Homo sapiens
attgcctacagtttgttgctgctg

SEQ ID NO: 21134 - DNA, 24 bp, Homo sapiens
aattgcctacagtttgttgctgct

SEQ ID NO: 21135 - DNA, 24 bp, Homo sapiens
caattgcctacagtttgttgctgc

SEQ ID NO: 21136 - DNA, 24 bp, Homo sapiens
gagagatgacgaccaagacctatg

SEQ ID NO: 21137 - DNA, 24 bp, Homo sapiens
ggagagatgacgaccaagacctat

SEQ ID NO: 21138 - DNA, 24 bp, Homo sapiens
tggagagatgacgaccaagaccta

SEQ ID NO: 21139 - DNA, 24 bp, Homo sapiens
ggatatgggaggtgattgaataca

SEQ ID NO: 21140 - DNA, 24 bp, Homo sapiens
aggatatgggaggtgattgaatac

SEQ ID NO: 21141 - DNA, 24 bp, Homo sapiens
gaggatatgggaggtgattgaata

SEQ ID NO: 21142 - DNA, 23 bp, Homo sapiens
gcaccaaggagagagcggaaagg

SEQ ID NO: 21143 - DNA, 25 bp, Homo sapiens
cctcagaaggacaacattccaatgc

SEQ ID NO: 21144 - DNA, 25 bp, Homo sapiens
agtggcagtggatgatagtgagagc

SEQ ID NO: 21145 - DNA, 25 bp, Homo sapiens
accgatttgttgtctgcccactttg

SEQ ID NO: 21146 - DNA, 25 bp, Homo sapiens
gtaactcgctcaaactgccttcctt

SEQ ID NO: 21147 - DNA, 25 bp, Homo sapiens
tacaaactccagggctgctctctcc

SEQ ID NO: 21148 - DNA, 24 bp, Homo sapiens
atggcctcaaaccacgacagccca

SEQ ID NO: 21149 - DNA, 24 bp, Homo sapiens
catggcctcaaaccacgacagccc

SEQ ID NO: 21150 - DNA, 24 bp, Homo sapiens
tcatggcctcaaaccacgacagcc

SEQ ID NO: 21151 - DNA, 24 bp, Homo sapiens
gggggccgcaggtgagcgatgttg

SEQ ID NO: 21152 - DNA, 24 bp, Homo sapiens
tgggggccgcaggtgagcgatgtt

SEQ ID NO: 21153 - DNA, 24 bp, Homo sapiens
ctgggggccgcaggtgagcgatgt

SEQ ID NO: 21154 - DNA, 24 bp, Homo sapiens
aggtgacaagggccctgcctccac

SEQ ID NO: 21155 - DNA, 24 bp, Homo sapiens
caggtgacaagggccctgcctcca

SEQ ID NO: 21156 - DNA, 24 bp, Homo sapiens
gcaggtgacaagggccctgcctcc

SEQ ID NO: 21157 - DNA, 25 bp, Homo sapiens
aaagcagaagtctcccgatggtgtg

SEQ ID NO: 21158 - DNA, 23 bp, Homo sapiens
gagtgtgctcacctctgtgccag

SEQ ID NO: 21159 - DNA, 23 bp, Homo sapiens
cccgatggtgtgcttgctgtgtg

SEQ ID NO: 21160 - DNA, 24 bp, Homo sapiens
cacctgtcaagatgtggacgagtg

SEQ ID NO: 21161 - DNA, 24 bp, Homo sapiens
acacctgtcaagatgtggacgagt

SEQ ID NO: 21162 - DNA, 24 bp, Homo sapiens
aacacctgtcaagatgtggacgag

SEQ ID NO: 21163 - DNA, 23 bp, Homo sapiens
ctccaccgtctgcttcaacaccg

SEQ ID NO: 21164 - DNA, 23 bp, Homo sapiens
gccagacgctttcccgattcttc

SEQ ID NO: 21165 - DNA, 24 bp, Homo sapiens
tcagccgaggtcaccatccagaat

SEQ ID NO: 21166 - DNA, 25 bp, Homo sapiens
agacacggaatcccgaataaccaaa

SEQ ID NO: 21167 - DNA, 23 bp, Homo sapiens
gctgccgctgccgcccaggctgg

SEQ ID NO: 21168 - DNA, 23 bp, Homo sapiens
ctcagaactcctcgtgtgtcaat

SEQ ID NO: 21169 - DNA, 23 bp, Homo sapiens
gcctgtcgctgcaatccagggtt

SEQ ID NO: 21170 - DNA, 23 bp, Homo sapiens
tttttctgagatcatcaccaccc

SEQ ID NO: 21171 - DNA, 24 bp, Homo sapiens
ggcagagactccaagacaagctca

SEQ ID NO: 21172 - DNA, 23 bp, Homo sapiens
ctccaccgtctgcttcaacaccg

SEQ ID NO: 21173 - DNA, 23 bp, Homo sapiens
ctccacccactgcctcaacaacg

SEQ ID NO: 21174 - DNA, 25 bp, Homo sapiens
gcttcttgggacctgtgaccttcat

SEQ ID NO: 21175 - DNA, 25 bp, Homo sapiens
ttcgtgactaccgtctggaagctca

SEQ ID NO: 21176 - DNA, 24 bp, Homo sapiens
cggagcttggtgctgacctatgtg

SEQ ID NO: 21177 - DNA, 24 bp, Homo sapiens
gtgtccaccttcacagggaaactc

SEQ ID NO: 21178 - DNA, 23 bp, Homo sapiens
ggcatagcacagctcacgatgaa

SEQ ID NO: 21179 - DNA, 24 bp, Homo sapiens
cgtcgtggtgaaggacttggatat

SEQ ID NO: 21180 - DNA, 25 bp, Homo sapiens
ggctcctctactggatctacactct

SEQ ID NO: 21181 - DNA, 25 bp, Homo sapiens
acaaggacagtcagggtgaaacttc

SEQ ID NO: 21182 - DNA, 25 bp, Homo sapiens
gttgaatttctgggaggatgacgca

SEQ ID NO: 21183 - DNA, 25 bp, Homo sapiens
agtcagggtgaaacttcttttgcca

SEQ ID NO: 21184 - DNA, 24 bp, Homo sapiens
actggatctacactctgtcccagg

SEQ ID NO: 21185 - DNA, 24 bp, Homo sapiens
tactggatctacactctgtcccag

SEQ ID NO: 21186 - DNA, 24 bp, Homo sapiens
ctactggatctacactctgtccca

SEQ ID NO: 21187 - DNA, 23 bp, Homo sapiens
ctgtttgagttggcagagagggc

SEQ ID NO: 21188 - DNA, 23 bp, Homo sapiens
gcatccaggcagtcttgtgagat

SEQ ID NO: 21189 - DNA, 23 bp, Homo sapiens
ggattgtgctggcagccaaggaa

SEQ ID NO: 21190 - DNA, 24 bp, Homo sapiens
acttgcttccgtgtgccccctacc

SEQ ID NO: 21191 - DNA, 24 bp, Homo sapiens
gacttgcttccgtgtgccccctac

SEQ ID NO: 21192 - DNA, 24 bp, Homo sapiens
ggacttgcttccgtgtgcccccta

SEQ ID NO: 21193 - DNA, 24 bp, Homo sapiens
ctgatgcgcaagtacaccgtgctc

SEQ ID NO: 21194 - DNA, 24 bp, Homo sapiens
gctgatgcgcaagtacaccgtgct

SEQ ID NO: 21195 - DNA, 24 bp, Homo sapiens
agctgatgcgcaagtacaccgtgc

SEQ ID NO: 21196 - DNA, 24 bp, Homo sapiens
gaccagatgccaagctccacagac

SEQ ID NO: 21197 - DNA, 24 bp, Homo sapiens
gcaatgtgaggacgcctagtgacc

SEQ ID NO: 21198 - DNA, 23 bp, Homo sapiens
gacgccaccgcttctccatcaac

SEQ ID NO: 21199 - DNA, 24 bp, Homo sapiens
ggagaaggaccaggtggaggaagt

SEQ ID NO: 21200 - DNA, 25 bp, Homo sapiens
gaagctccaggaggaagaagatcgg

SEQ ID NO: 21201 - DNA, 25 bp, Homo sapiens
cggctaatgattcgacagaggctgg

SEQ ID NO: 21202 - DNA, 23 bp, Homo sapiens
aaggctgtgtctacggcaggctg

SEQ ID NO: 21203 - DNA, 25 bp, Homo sapiens
aggaagaagacgagttcattgtgga

SEQ ID NO: 21204 - DNA, 23 bp, Homo sapiens
gcaggatgacaacgaacgcattc

SEQ ID NO: 21205 - DNA, 25 bp, Homo sapiens
aggaagaatggactacagccaccaa

SEQ ID NO: 21206 - DNA, 25 bp, Homo sapiens
aggaagaagacgagttcattgtgga

SEQ ID NO: 21207 - DNA, 23 bp, Homo sapiens
gcaggatgacaacgaacgcattc

SEQ ID NO: 21208 - DNA, 24 bp, Homo sapiens
tcgggagagcaaaggctgtgtcta

SEQ ID NO: 21209 - DNA, 23 bp, Homo sapiens
gagaggacagcggacgagcagat

SEQ ID NO: 21210 - DNA, 25 bp, Homo sapiens
ggtggagagtgatatgaagagcgag

SEQ ID NO: 21211 - DNA, 24 bp, Homo sapiens
gcaatgtgaggacgcctagtgacc

SEQ ID NO: 21212 - DNA, 23 bp, Homo sapiens
gacgccaccgcttctccatcaac

SEQ ID NO: 21213 - DNA, 25 bp, Homo sapiens
caaccataagacatccgtgttcaca

SEQ ID NO: 21214 - DNA, 23 bp, Homo sapiens
gacgccaccgcttctccatcaac

SEQ ID NO: 21215 - DNA, 24 bp, Homo sapiens
gcaatgtgaggacgcctagtgacc

SEQ ID NO: 21216 - DNA, 24 bp, Homo sapiens
ctcctcctggcactctggctgtaa

SEQ ID NO: 21217 - DNA, 25 bp, Homo sapiens
cggctaatgattcgacagaggctgg

SEQ ID NO: 21218 - DNA, 25 bp, Homo sapiens
agcaacaatctgagccatgagaacg

SEQ ID NO: 21219 - DNA, 25 bp, Homo sapiens
ctggatgtagaagtcagcagacagc

SEQ ID NO: 21220 - DNA, 25 bp, Homo sapiens
atgattcgacagaggctggaggaga

SEQ ID NO: 21221 - DNA, 25 bp, Homo sapiens
agcaacaatctgagccatgagaacg

SEQ ID NO: 21222 - DNA, 25 bp, Homo sapiens
ctggatgtagaagtcagcagacagc

SEQ ID NO: 21223 - DNA, 24 bp, Homo sapiens
tttgattacagtccccctctacac

SEQ ID NO: 21224 - DNA, 24 bp, Homo sapiens
ctttgattacagtccccctctaca

SEQ ID NO: 21225 - DNA, 24 bp, Homo sapiens
tctttgattacagtccccctctac

SEQ ID NO: 21226 - DNA, 24 bp, Homo sapiens
tgattctcaccgtcctgaagtcaa

SEQ ID NO: 21227 - DNA, 25 bp, Homo sapiens
tggcacctgttcctcttgatgattc

SEQ ID NO: 21228 - DNA, 25 bp, Homo sapiens
ggctgcttgctagtacacttgtcca

SEQ ID NO: 21229 - DNA, 25 bp, Homo sapiens
ttcagagaggaaagcccacttagga

SEQ ID NO: 21230 - DNA, 24 bp, Homo sapiens
tgattctcaccgtcctgaagtcaa

SEQ ID NO: 21231 - DNA, 25 bp, Homo sapiens
tggcacctgttcctcttgatgattc

SEQ ID NO: 21232 - DNA, 25 bp, Homo sapiens
gcggttcacttcgtatcagaaagcc

SEQ ID NO: 21233 - DNA, 25 bp, Homo sapiens
tgaggaagcatacccgtttagcagg

SEQ ID NO: 21234 - DNA, 23 bp, Homo sapiens
gtgtgactctgctgaccttcggc

SEQ ID NO: 21235 - DNA, 24 bp, Homo sapiens
ggttcaagcgattctcctgcctca

SEQ ID NO: 21236 - DNA, 25 bp, Homo sapiens
caggctggagtgcaatgacatgatc

SEQ ID NO: 21237 - DNA, 23 bp, Homo sapiens
gatcttcccacatcagcctcctg

SEQ ID NO: 21238 - DNA, 24 bp, Homo sapiens
tcgacctaaagatgcagccacccc

SEQ ID NO: 21239 - DNA, 24 bp, Homo sapiens
atcgacctaaagatgcagccaccc

SEQ ID NO: 21240 - DNA, 24 bp, Homo sapiens
catcgacctaaagatgcagccacc

SEQ ID NO: 21241 - DNA, 24 bp, Homo sapiens
gcccggccacgcatcttcatgata

SEQ ID NO: 21242 - DNA, 24 bp, Homo sapiens
cgcccggccacgcatcttcatgat

SEQ ID NO: 21243 - DNA, 24 bp, Homo sapiens
ccgcccggccacgcatcttcatga

SEQ ID NO: 21244 - DNA, 24 bp, Homo sapiens
gattcggttaggaggaacagcaca

SEQ ID NO: 21245 - DNA, 24 bp, Homo sapiens
ggattcggttaggaggaacagcac

SEQ ID NO: 21246 - DNA, 24 bp, Homo sapiens
aggattcggttaggaggaacagca

SEQ ID NO: 21247 - DNA, 23 bp, Homo sapiens
caagctggtctcaaactcctggc

SEQ ID NO: 21248 - DNA, 23 bp, Homo sapiens
tgatcctctccccttggcctccc

SEQ ID NO: 21249 - DNA, 23 bp, Homo sapiens
gaggcaggagaatggcgtgaacc

SEQ ID NO: 21250 - DNA, 24 bp, Homo sapiens
agaccatcctggctaacacggtga

SEQ ID NO: 21251 - DNA, 23 bp, Homo sapiens
gcagtgagctgagatagcaccac

SEQ ID NO: 21252 - DNA, 24 bp, Homo sapiens
gacggatgcaggtgacttgacgtg

SEQ ID NO: 21253 - DNA, 24 bp, Homo sapiens
agacggatgcaggtgacttgacgt

SEQ ID NO: 21254 - DNA, 24 bp, Homo sapiens
gagacggatgcaggtgacttgacg

SEQ ID NO: 21255 - DNA, 24 bp, Homo sapiens
gggttcaaaaggtaactgctcaaa

SEQ ID NO: 21256 - DNA, 24 bp, Homo sapiens
cgggttcaaaaggtaactgctcaa

SEQ ID NO: 21257 - DNA, 24 bp, Homo sapiens
tcgggttcaaaaggtaactgctca

SEQ ID NO: 21258 - DNA, 25 bp, Homo sapiens
acttgagtgacgagctgagaattat

SEQ ID NO: 21259 - DNA, 24 bp, Homo sapiens
tgcagaaaaagttgcttggaaaag

SEQ ID NO: 21260 - DNA, 24 bp, Homo sapiens
atgcagaaaaagttgcttggaaaa

SEQ ID NO: 21261 - DNA, 24 bp, Homo sapiens
tatgcagaaaaagttgcttggaaa

SEQ ID NO: 21262 - DNA, 25 bp, Homo sapiens
acggacagactagccttctatctct

SEQ ID NO: 21263 - DNA, 25 bp, Homo sapiens
aatacctcaaatggcagacagcagc

SEQ ID NO: 21264 - DNA, 23 bp, Homo sapiens
acgatgaagttgacaggcgagag

SEQ ID NO: 21265 - DNA, 24 bp, Homo sapiens
gaaaatctccagaaatttgtgaag

SEQ ID NO: 21266 - DNA, 24 bp, Homo sapiens
tgaaaatctccagaaatttgtgaa

SEQ ID NO: 21267 - DNA, 24 bp, Homo sapiens
ttgaaaatctccagaaatttgtga

SEQ ID NO: 21268 - DNA, 25 bp, Homo sapiens
tttatcagcaaagttttggactgga

SEQ ID NO: 21269 - DNA, 24 bp, Homo sapiens
cggaacaacagaccaattttaaca

SEQ ID NO: 21270 - DNA, 24 bp, Homo sapiens
gcggaacaacagaccaattttaac

SEQ ID NO: 21271 - DNA, 24 bp, Homo sapiens
tgcggaacaacagaccaattttaa

SEQ ID NO: 21272 - DNA, 24 bp, Homo sapiens
ttttatgcaaaagtcagcgtgaca

SEQ ID NO: 21273 - DNA, 24 bp, Homo sapiens
tttttatgcaaaagtcagcgtgac

SEQ ID NO: 21274 - DNA, 24 bp, Homo sapiens
ctttttatgcaaaagtcagcgtga

SEQ ID NO: 21275 - DNA, 24 bp, Homo sapiens
ttgtcctgcagtgctcattcatca

SEQ ID NO: 21276 - DNA, 24 bp, Homo sapiens
tttgtcctgcagtgctcattcatc

SEQ ID NO: 21277 - DNA, 24 bp, Homo sapiens
atttgtcctgcagtgctcattcat

SEQ ID NO: 21278 - DNA, 25 bp, Homo sapiens
aaacagcaggccatctttttatgca

SEQ ID NO: 21279 - DNA, 25 bp, Homo sapiens
gcgtgacaatatacttcactggtgt

SEQ ID NO: 21280 - DNA, 25 bp, Homo sapiens
ttttaactggcttcattttaggaat

SEQ ID NO: 21281 - DNA, 25 bp, Homo sapiens
aagttcagccattcctcagggttcc

SEQ ID NO: 21282 - DNA, 25 bp, Homo sapiens
tgactttgaacctctacaccagcat

SEQ ID NO: 21283 - DNA, 25 bp, Homo sapiens
agcagcacaaagtttggatgaaatg

SEQ ID NO: 21284 - DNA, 25 bp, Homo sapiens
aacctctacaccagcatgtacttgc

SEQ ID NO: 21285 - DNA, 25 bp, Homo sapiens
agcagcacaaagtttggatgaaatg

SEQ ID NO: 21286 - DNA, 25 bp, Homo sapiens
ccacagtctgcttcttcaccaagga

SEQ ID NO: 21287 - DNA, 24 bp, Homo sapiens
ggcagaacttcagtccttggagca

SEQ ID NO: 21288 - DNA, 25 bp, Homo sapiens
cacacttcaggttaggcacatacaa

SEQ ID NO: 21289 - DNA, 25 bp, Homo sapiens
ggagagttagtatgccttgaggagg

SEQ ID NO: 21290 - DNA, 23 bp, Homo sapiens
ttgattgcggaacaacagaccaa

SEQ ID NO: 21291 - DNA, 25 bp, Homo sapiens
gcagcaacaagaacgggataaagat

SEQ ID NO: 21292 - DNA, 25 bp, Homo sapiens
agaagtcagtaagttgcgtagtagc

SEQ ID NO: 21293 - DNA, 25 bp, Homo sapiens
agaagtcagtaagttgcgtagtagc

SEQ ID NO: 21294 - DNA, 25 bp, Homo sapiens
ggtgaatcagatagatccgctgtgg

SEQ ID NO: 21295 - DNA, 25 bp, Homo sapiens
gtggattcagcaatggagacaagca

SEQ ID NO: 21296 - DNA, 24 bp, Homo sapiens
gcggataatgctgttagaacgaac

SEQ ID NO: 21297 - DNA, 25 bp, Homo sapiens
tgatgtctcagagcatgtcttcagt

SEQ ID NO: 21298 - DNA, 25 bp, Homo sapiens
actcatcatcctagacgaacgccat

SEQ ID NO: 21299 - DNA, 24 bp, Homo sapiens
gcggataatgctgttagaacgaac

SEQ ID NO: 21300 - DNA, 25 bp, Homo sapiens
gtggattcagcaatggagacaagca

SEQ ID NO: 21301 - DNA, 25 bp, Homo sapiens
ggtgaatcagatagatccgctgtgg

SEQ ID NO: 21302 - DNA, 25 bp, Homo sapiens
acagagtgaaagccgtatcatggaa

SEQ ID NO: 21303 - DNA, 25 bp, Homo sapiens
agaaatgcggaccaaactacttcat

SEQ ID NO: 21304 - DNA, 25 bp, Homo sapiens
accttgtgcattgtggcttatgatg

SEQ ID NO: 21305 - DNA, 24 bp, Homo sapiens
ggatcatcaaagtcaacggcacca

SEQ ID NO: 21306 - DNA, 24 bp, Homo sapiens
cggatcatcaaagtcaacggcacc

SEQ ID NO: 21307 - DNA, 24 bp, Homo sapiens
ccggatcatcaaagtcaacggcac

SEQ ID NO: 21308 - DNA, 25 bp, Homo sapiens
aggttaagtagcctgtcttctctgg

SEQ ID NO: 21309 - DNA, 25 bp, Homo sapiens
acaggattctggaaccgtggagaca

SEQ ID NO: 21310 - DNA, 23 bp, Homo sapiens
gccctcctctcaccttgctcaaa

SEQ ID NO: 21311 - DNA, 25 bp, Homo sapiens
cgttacatcttctctcaggcggacc

SEQ ID NO: 21312 - DNA, 25 bp, Homo sapiens
aacgagagcgacatcatattccagg

SEQ ID NO: 21313 - DNA, 23 bp, Homo sapiens
gcccagaggaagactatgacccg

SEQ ID NO: 21314 - DNA, 25 bp, Homo sapiens
cctcagacagcaagcagaccttcag

SEQ ID NO: 21315 - DNA, 24 bp, Homo sapiens
ggacctcctagtgctgctacagaa

SEQ ID NO: 21316 - DNA, 24 bp, Homo sapiens
gcagcagagttcaagagcctggat

SEQ ID NO: 21317 - DNA, 25 bp, Homo sapiens
tcatcctagtggacctgcgtctacc

SEQ ID NO: 21318 - DNA, 23 bp, Homo sapiens
cacctccacctctgcgtctccaa

SEQ ID NO: 21319 - DNA, 25 bp, Homo sapiens
aacacatccagtgcttccagtgacc

SEQ ID NO: 21320 - DNA, 23 bp, Homo sapiens
caattctcctgcctcagcctgcc

SEQ ID NO: 21321 - DNA, 23 bp, Homo sapiens
ctcactgcaacttccgcctcctg

SEQ ID NO: 21322 - DNA, 23 bp, Homo sapiens
caggctggagtacagtggtgcat

SEQ ID NO: 21323 - DNA, 24 bp, Homo sapiens
agatggtccagaagaaatgaagga

SEQ ID NO: 21324 - DNA, 24 bp, Homo sapiens
tagatggtccagaagaaatgaagg

SEQ ID NO: 21325 - DNA, 24 bp, Homo sapiens
gtagatggtccagaagaaatgaag

SEQ ID NO: 21326 - DNA, 24 bp, Homo sapiens
agaagaaaatgacctgccacctgg

SEQ ID NO: 21327 - DNA, 24 bp, Homo sapiens
aagaagaaaatgacctgccacctg

SEQ ID NO: 21328 - DNA, 24 bp, Homo sapiens
caagaagaaaatgacctgccacct

SEQ ID NO: 21329 - DNA, 24 bp, Homo sapiens
tcttctggcaggattcccttcaat

SEQ ID NO: 21330 - DNA, 24 bp, Homo sapiens
ttcttctggcaggattcccttcaa

SEQ ID NO: 21331 - DNA, 24 bp, Homo sapiens
cttcttctggcaggattcccttca

SEQ ID NO: 21332 - DNA, 23 bp, Homo sapiens
tcacccaggctggtctcgaactc

SEQ ID NO: 21333 - DNA, 23 bp, Homo sapiens
ggatcctcccaccttggcatccc

SEQ ID NO: 21334 - DNA, 24 bp, Homo sapiens
agtctccagtggctcagcaagagg

SEQ ID NO: 21335 - DNA, 24 bp, Homo sapiens
acacaagttccagtctccagcagt

SEQ ID NO: 21336 - DNA, 24 bp, Homo sapiens
acccagcatacacccagcccacag

SEQ ID NO: 21337 - DNA, 24 bp, Homo sapiens
tgcacatttcggaatcttctgcgg

SEQ ID NO: 21338 - DNA, 24 bp, Homo sapiens
ctgcacatttcggaatcttctgcg

SEQ ID NO: 21339 - DNA, 24 bp, Homo sapiens
gctgcacatttcggaatcttctgc

SEQ ID NO: 21340 - DNA, 24 bp, Homo sapiens
ttttttcagcctatttgatggctt

SEQ ID NO: 21341 - DNA, 24 bp, Homo sapiens
tttttttcagcctatttgatggct

SEQ ID NO: 21342 - DNA, 24 bp, Homo sapiens
ttttttttcagcctatttgatggc

SEQ ID NO: 21343 - DNA, 24 bp, Homo sapiens
ttgtttttcagactgctctggccc

SEQ ID NO: 21344 - DNA, 24 bp, Homo sapiens
tttgtttttcagactgctctggcc

SEQ ID NO: 21345 - DNA, 24 bp, Homo sapiens
ttttgtttttcagactgctctggc

SEQ ID NO: 21346 - DNA, 24 bp, Homo sapiens
agatcacactgctattggtcagga

SEQ ID NO: 21347 - DNA, 24 bp, Homo sapiens
aagatcacactgctattggtcagg

SEQ ID NO: 21348 - DNA, 24 bp, Homo sapiens
gaagatcacactgctattggtcag

SEQ ID NO: 21349 - DNA, 24 bp, Homo sapiens
agatcacactggtaagggcaaagt

SEQ ID NO: 21350 - DNA, 24 bp, Homo sapiens
aagatcacactggtaagggcaaag

SEQ ID NO: 21351 - DNA, 24 bp, Homo sapiens
gaagatcacactggtaagggcaaa

SEQ ID NO: 21352 - DNA, 24 bp, Homo sapiens
ggctacaaaagtcgggaacatgcc

SEQ ID NO: 21353 - DNA, 24 bp, Homo sapiens
tggctacaaaagtcgggaacatgc

SEQ ID NO: 21354 - DNA, 24 bp, Homo sapiens
ttggctacaaaagtcgggaacatg

SEQ ID NO: 21355 - DNA, 22 bp, Homo sapiens
cgctccggagccgctgcacatt

SEQ ID NO: 21356 - DNA, 25 bp, Homo sapiens
ggctggtgatgactatgaagtgttg

SEQ ID NO: 21357 - DNA, 25 bp, Homo sapiens
caggcaggagatatggaagaagaca

SEQ ID NO: 21358 - DNA, 25 bp, Homo sapiens
caagaatctggtaaggctgtctggc

SEQ ID NO: 21359 - DNA, 24 bp, Homo sapiens
gctgtccaatctgttgcagtgagt

SEQ ID NO: 21360 - DNA, 23 bp, Homo sapiens
caccatttctttcacaaaccttg

SEQ ID NO: 21361 - DNA, 23 bp, Homo sapiens
aggatgatatagcaacagagttg

SEQ ID NO: 21362 - DNA, 25 bp, Homo sapiens
cacctgcggttattgaagcatctgc

SEQ ID NO: 21363 - DNA, 24 bp, Homo sapiens
tcctctgagcctgatcctgatgcc

SEQ ID NO: 21364 - DNA, 25 bp, Homo sapiens
gcagaagcaccctaaaccttgacag

SEQ ID NO: 21365 - DNA, 24 bp, Homo sapiens
tccaaatatgggtgctgtgaggag

SEQ ID NO: 21366 - DNA, 24 bp, Homo sapiens
gtccaaatatgggtgctgtgagga

SEQ ID NO: 21367 - DNA, 24 bp, Homo sapiens
cgtccaaatatgggtgctgtgagg

SEQ ID NO: 21368 - DNA, 25 bp, Homo sapiens
tgcctatgattaccaccctcctgct

SEQ ID NO: 21369 - DNA, 25 bp, Homo sapiens
gaatcaggtctggctctatgctggc

SEQ ID NO: 21370 - DNA, 25 bp, Homo sapiens
gatggctatgcttcctatgtcacac

SEQ ID NO: 21371 - DNA, 25 bp, Homo sapiens
ggctcaagtccagtaagaggcatac

SEQ ID NO: 21372 - DNA, 25 bp, Homo sapiens
attccactccttcctcatctgttcg

SEQ ID NO: 21373 - DNA, 23 bp, Homo sapiens
agcccttctcctactgcattagc

SEQ ID NO: 21374 - DNA, 24 bp, Homo sapiens
tgaagatggagtttcccggaggaa

SEQ ID NO: 21375 - DNA, 24 bp, Homo sapiens
gtgaagatggagtttcccggagga

SEQ ID NO: 21376 - DNA, 24 bp, Homo sapiens
tgtgaagatggagtttcccggagg

SEQ ID NO: 21377 - DNA, 24 bp, Homo sapiens
caggggccgagacattccatacac

SEQ ID NO: 21378 - DNA, 24 bp, Homo sapiens
tcaggggccgagacattccataca

SEQ ID NO: 21379 - DNA, 24 bp, Homo sapiens
gtcaggggccgagacattccatac

SEQ ID NO: 21380 - DNA, 24 bp, Homo sapiens
caggggccgaggtgagccagagct

SEQ ID NO: 21381 - DNA, 24 bp, Homo sapiens
tcaggggccgaggtgagccagagc

SEQ ID NO: 21382 - DNA, 24 bp, Homo sapiens
gtcaggggccgaggtgagccagag

SEQ ID NO: 21383 - DNA, 23 bp, Homo sapiens
ttgagcagccagcagaacagagc

SEQ ID NO: 21384 - DNA, 25 bp, Homo sapiens
tgacttgtccaacagtgcgacttct

SEQ ID NO: 21385 - DNA, 25 bp, Homo sapiens
gctggcacacggagggatttattca

SEQ ID NO: 21386 - DNA, 25 bp, Homo sapiens
ggtcagcccaatatcaccaagttga

SEQ ID NO: 21387 - DNA, 25 bp, Homo sapiens
tgtctcaaggagggatggttactgt

SEQ ID NO: 21388 - DNA, 23 bp, Homo sapiens
gacctcccgagggctccaactag

SEQ ID NO: 21389 - DNA, 24 bp, Homo sapiens
ccagccacagtggtgacctcccga

SEQ ID NO: 21390 - DNA, 24 bp, Homo sapiens
cccagccacagtggtgacctcccg

SEQ ID NO: 21391 - DNA, 24 bp, Homo sapiens
tcccagccacagtggtgacctccc

SEQ ID NO: 21392 - DNA, 24 bp, Homo sapiens
cacctcctatggctactgttgacc

SEQ ID NO: 21393 - DNA, 25 bp, Homo sapiens
accctctcatcctatgtggcaaacc

SEQ ID NO: 21394 - DNA, 24 bp, Homo sapiens
cagcccagtcaacaagcccagatt

SEQ ID NO: 21395 - DNA, 24 bp, Homo sapiens
gagctaagatctgaaaaagaagga

SEQ ID NO: 21396 - DNA, 24 bp, Homo sapiens
ggagctaagatctgaaaaagaagg

SEQ ID NO: 21397 - DNA, 24 bp, Homo sapiens
gggagctaagatctgaaaaagaag

SEQ ID NO: 21398 - DNA, 24 bp, Homo sapiens
accctgcccagaatctgctggagc

SEQ ID NO: 21399 - DNA, 24 bp, Homo sapiens
caccctgcccagaatctgctggag

SEQ ID NO: 21400 - DNA, 24 bp, Homo sapiens
ccaccctgcccagaatctgctgga

SEQ ID NO: 21401 - DNA, 25 bp, Homo sapiens
tttacctttaccctgcctgctgctg

SEQ ID NO: 21402 - DNA, 25 bp, Homo sapiens
cccaagcaccaacccactgttagag

SEQ ID NO: 21403 - DNA, 24 bp, Homo sapiens
cctccaaagacacccagcctccta

SEQ ID NO: 21404 - DNA, 24 bp, Homo sapiens
cagcaggccagggtttccgccccc

SEQ ID NO: 21405 - DNA, 24 bp, Homo sapiens
ccagcaggccagggtttccgcccc

SEQ ID NO: 21406 - DNA, 24 bp, Homo sapiens
cccagcaggccagggtttccgccc

SEQ ID NO: 21407 - DNA, 25 bp, Homo sapiens
ccacattccttacagccagcaacgg

SEQ ID NO: 21408 - DNA, 25 bp, Homo sapiens
ggacctcaacaatcacagccacctt

SEQ ID NO: 21409 - DNA, 25 bp, Homo sapiens
tcagccaacagcacagtctacaagc

SEQ ID NO: 21410 - DNA, 25 bp, Homo sapiens
cgaactcctgacctgaggcaatctg

SEQ ID NO: 21411 - DNA, 23 bp, Homo sapiens
cactgtgcccagccgagttcttt

SEQ ID NO: 21412 - DNA, 23 bp, Homo sapiens
cccaaagtgctgggattacaggc

SEQ ID NO: 21413 - DNA, 25 bp, Homo sapiens
tggagatggagatggagcaggtgtt

SEQ ID NO: 21414 - DNA, 25 bp, Homo sapiens
ccctctggcacaaatggaagaagaa

SEQ ID NO: 21415 - DNA, 25 bp, Homo sapiens
gtccactatgagaactacagaagca

SEQ ID NO: 21416 - DNA, 24 bp, Homo sapiens
acccagccctggtcagccctgaaa

SEQ ID NO: 21417 - DNA, 24 bp, Homo sapiens
gacccagccctggtcagccctgaa

SEQ ID NO: 21418 - DNA, 24 bp, Homo sapiens
ggacccagccctggtcagccctga

SEQ ID NO: 21419 - DNA, 24 bp, Homo sapiens
atctgttgaaggtgctacaggctc

SEQ ID NO: 21420 - DNA, 24 bp, Homo sapiens
aatctgttgaaggtgctacaggct

SEQ ID NO: 21421 - DNA, 24 bp, Homo sapiens
caatctgttgaaggtgctacaggc

SEQ ID NO: 21422 - DNA, 23 bp, Homo sapiens
ctcctacctcttccaagcagcat

SEQ ID NO: 21423 - DNA, 24 bp, Homo sapiens
acagttacaccagcctgccatact

SEQ ID NO: 21424 - DNA, 24 bp, Homo sapiens
gactcaccataccacgcagcagac

SEQ ID NO: 21425 - DNA, 23 bp, Homo sapiens
ccatcagcagccgcattctcaga

SEQ ID NO: 21426 - DNA, 25 bp, Homo sapiens
tgctgcttccttcaacttgccttca

SEQ ID NO: 21427 - DNA, 23 bp, Homo sapiens
ttcagtcacctccagtaacacgg

SEQ ID NO: 21428 - DNA, 24 bp, Homo sapiens
cattctcagatccttcaccatcac

SEQ ID NO: 21429 - DNA, 25 bp, Homo sapiens
tgctgcttccttcaacttgccttca

SEQ ID NO: 21430 - DNA, 23 bp, Homo sapiens
tgcacattctgaccccccatcag

SEQ ID NO: 21431 - DNA, 25 bp, Homo sapiens
ttcatctaaccagagtcaggagtct

SEQ ID NO: 21432 - DNA, 25 bp, Homo sapiens
gactcaggcaaagaatggcttcagt

SEQ ID NO: 21433 - DNA, 24 bp, Homo sapiens
tgttgaaggtgctacaggctctgc

SEQ ID NO: 21434 - DNA, 24 bp, Homo sapiens
tgttgaaggtgctacaggctctgc

SEQ ID NO: 21435 - DNA, 25 bp, Homo sapiens
tctgattcaccttccacttctagca

SEQ ID NO: 21436 - DNA, 25 bp, Homo sapiens
acgacaaccaatcagcattcatcct

SEQ ID NO: 21437 - DNA, 25 bp, Homo sapiens
acgacaaccaatcagcattcatcct

SEQ ID NO: 21438 - DNA, 24 bp, Homo sapiens
gcttgagccacagtgaggagattc

SEQ ID NO: 21439 - DNA, 25 bp, Homo sapiens
tctgattcaccttccacttctagca

SEQ ID NO: 21440 - DNA, 24 bp, Homo sapiens
ccgccgttgttgcctaatccgtat

SEQ ID NO: 21441 - DNA, 25 bp, Homo sapiens
ggtcagtgtctcctccagtctcaat

SEQ ID NO: 21442 - DNA, 24 bp, Homo sapiens
tccaccacatccagcacagtctct

SEQ ID NO: 21443 - DNA, 25 bp, Homo sapiens
atggtgtgaatgtcagtgtgaatgc

SEQ ID NO: 21444 - DNA, 23 bp, Homo sapiens
ttcagtcacctccagtaacacgg

SEQ ID NO: 21445 - DNA, 25 bp, Homo sapiens
tgctgcttccttcaacttgccttca

SEQ ID NO: 21446 - DNA, 25 bp, Homo sapiens
aaacccagcagtcctttgagaaaca

SEQ ID NO: 21447 - DNA, 25 bp, Homo sapiens
tgctgcttccttcaacttgccttca

SEQ ID NO: 21448 - DNA, 23 bp, Homo sapiens
ccatcagcagccgcattctcaga

SEQ ID NO: 21449 - DNA, 24 bp, Homo sapiens
cttccctggaaattctgctgtcca

SEQ ID NO: 21450 - DNA, 24 bp, Homo sapiens
ccttccctggaaattctgctgtcc

SEQ ID NO: 21451 - DNA, 24 bp, Homo sapiens
accttccctggaaattctgctgtc

SEQ ID NO: 21452 - DNA, 24 bp, Homo sapiens
tacaaggttctgctggccacactg

SEQ ID NO: 21453 - DNA, 24 bp, Homo sapiens
cctctcccctcggaccctgccccg

SEQ ID NO: 21454 - DNA, 23 bp, Homo sapiens
gcggcagcagcaaactctttagc

SEQ ID NO: 21455 - DNA, 23 bp, Homo sapiens
gtcccgtcgctccagttcacaga

SEQ ID NO: 21456 - DNA, 25 bp, Homo sapiens
agacttttaacaagatgcctcctca

SEQ ID NO: 21457 - DNA, 25 bp, Homo sapiens
gttgttgccacagagtcacatcagt

SEQ ID NO: 21458 - DNA, 25 bp, Homo sapiens
ccgttgtggacacatcttctgctgg

SEQ ID NO: 21459 - DNA, 25 bp, Homo sapiens
tgtagccatgaagtgccatcttgcc

SEQ ID NO: 21460 - DNA, 25 bp, Homo sapiens
cacagtcaatcaatagccaacctca

SEQ ID NO: 21461 - DNA, 25 bp, Homo sapiens
ttcagccatgtccatgatgcctacc

SEQ ID NO: 21462 - DNA, 25 bp, Homo sapiens
gacaggacagaagagaactcagaat

SEQ ID NO: 21463 - DNA, 25 bp, Homo sapiens
ctcgatgcaactctatcgtcacagt

SEQ ID NO: 21464 - DNA, 23 bp, Homo sapiens
aaataagagacacatggctgagg

SEQ ID NO: 21465 - DNA, 24 bp, Homo sapiens
gaactggaccccgttaccacagaa

SEQ ID NO: 21466 - DNA, 24 bp, Homo sapiens
agaactggaccccgttaccacaga

SEQ ID NO: 21467 - DNA, 24 bp, Homo sapiens
cagaactggaccccgttaccacag

SEQ ID NO: 21468 - DNA, 24 bp, Homo sapiens
caagacgtgctgacacagtgagtt

SEQ ID NO: 21469 - DNA, 25 bp, Homo sapiens
gcttgagttactcctgtatcattgc

SEQ ID NO: 21470 - DNA, 25 bp, Homo sapiens
tttaatgctgctgacattgttgttt

SEQ ID NO: 21471 - DNA, 23 bp, Homo sapiens
ctacctccgagacctcccagagc

SEQ ID NO: 21472 - DNA, 25 bp, Homo sapiens
gctctccatccttcctcgtgacaac

SEQ ID NO: 21473 - DNA, 25 bp, Homo sapiens
caagatgagtgtggacaacctggct

SEQ ID NO: 21474 - DNA, 25 bp, Homo sapiens
ggctcaatgaagaactggagaagga

SEQ ID NO: 21475 - DNA, 24 bp, Homo sapiens
cctagagatcagcctccgcaacat

SEQ ID NO: 21476 - DNA, 24 bp, Homo sapiens
atgaaggaacccaagaccgaggct

SEQ ID NO: 21477 - DNA, 24 bp, Homo sapiens
ggatggggacgagagcattcacaa

SEQ ID NO: 21478 - DNA, 24 bp, Homo sapiens
aggatggggacgagagcattcaca

SEQ ID NO: 21479 - DNA, 24 bp, Homo sapiens
gaggatggggacgagagcattcac

SEQ ID NO: 21480 - DNA, 24 bp, Homo sapiens
tgtcccctcaggtctctgcatgga

SEQ ID NO: 21481 - DNA, 24 bp, Homo sapiens
ctgtcccctcaggtctctgcatgg

SEQ ID NO: 21482 - DNA, 24 bp, Homo sapiens
tctgtcccctcaggtctctgcatg

SEQ ID NO: 21483 - DNA, 24 bp, Homo sapiens
gtgacttaaaggatgatgatgcag

SEQ ID NO: 21484 - DNA, 24 bp, Homo sapiens
agtgacttaaaggatgatgatgca

SEQ ID NO: 21485 - DNA, 24 bp, Homo sapiens
gagtgacttaaaggatgatgatgc

SEQ ID NO: 21486 - DNA, 23 bp, Homo sapiens
ttcccccagccctatggaccccc

SEQ ID NO: 21487 - DNA, 24 bp, Homo sapiens
ttagttaccaggtgattggcgagg

SEQ ID NO: 21488 - DNA, 24 bp, Homo sapiens
gttagttaccaggtgattggcgag

SEQ ID NO: 21489 - DNA, 24 bp, Homo sapiens
agttagttaccaggtgattggcga

SEQ ID NO: 21490 - DNA, 24 bp, Homo sapiens
ggggacacctggtacctagtcgat

SEQ ID NO: 21491 - DNA, 24 bp, Homo sapiens
aggggacacctggtacctagtcga

SEQ ID NO: 21492 - DNA, 24 bp, Homo sapiens
aaggggacacctggtacctagtcg

SEQ ID NO: 21493 - DNA, 24 bp, Homo sapiens
ttgagaatgtgccgatatgtcaaa

SEQ ID NO: 21494 - DNA, 24 bp, Homo sapiens
cttgagaatgtgccgatatgtcaa

SEQ ID NO: 21495 - DNA, 24 bp, Homo sapiens
tcttgagaatgtgccgatatgtca

SEQ ID NO: 21496 - DNA, 24 bp, Homo sapiens
accaaattgtgtccaaagcagcat

SEQ ID NO: 21497 - DNA, 24 bp, Homo sapiens
gaccaaattgtgtccaaagcagca

SEQ ID NO: 21498 - DNA, 24 bp, Homo sapiens
agaccaaattgtgtccaaagcagc

SEQ ID NO: 21499 - DNA, 24 bp, Homo sapiens
tagcacgaaaggtggttgaacagg

SEQ ID NO: 21500 - DNA, 24 bp, Homo sapiens
atagcacgaaaggtggttgaacag

SEQ ID NO: 21501 - DNA, 24 bp, Homo sapiens
aatagcacgaaaggtggttgaaca

SEQ ID NO: 21502 - DNA, 25 bp, Homo sapiens
tctcaatgcttcctggtccttgctt

SEQ ID NO: 21503 - DNA, 25 bp, Homo sapiens
agtcagaagtcggaatcagaagaga

SEQ ID NO: 21504 - DNA, 25 bp, Homo sapiens
tcgaccacatccatccttagctctc

SEQ ID NO: 21505 - DNA, 23 bp, Homo sapiens
ggaaggtcaagagccaatagcac

SEQ ID NO: 21506 - DNA, 25 bp, Homo sapiens
ggacttctcaaagatggtgatgccc

SEQ ID NO: 21507 - DNA, 25 bp, Homo sapiens
atgttggctttgacagttgggacaa

SEQ ID NO: 21508 - DNA, 25 bp, Homo sapiens
aataggacagaagatacagagcacg

SEQ ID NO: 21509 - DNA, 24 bp, Homo sapiens
tcctgctcttgagaatgtgccgat

SEQ ID NO: 21510 - DNA, 25 bp, Homo sapiens
tccctacactgctgtaaggaccaaa

SEQ ID NO: 21511 - DNA, 23 bp, Homo sapiens
tggacacccagcggtctgacatc

SEQ ID NO: 21512 - DNA, 23 bp, Homo sapiens
gaagaagatggcggaaggcggag

SEQ ID NO: 21513 - DNA, 25 bp, Homo sapiens
atgttggctttgacagttgggacaa

SEQ ID NO: 21514 - DNA, 25 bp, Homo sapiens
gatagtcgctggttcaaacagtgga

SEQ ID NO: 21515 - DNA, 23 bp, Homo sapiens
tggacacccagcggtctgacatc

SEQ ID NO: 21516 - DNA, 25 bp, Homo sapiens
ggaaggtcaagagccaatagcacga

SEQ ID NO: 21517 - DNA, 25 bp, Homo sapiens
ggacttctcaaagatggtgatgccc

SEQ ID NO: 21518 - DNA, 25 bp, Homo sapiens
atgttggctttgacagttgggacaa

SEQ ID NO: 21519 - DNA, 24 bp, Homo sapiens
acgcactgcctcgaagaagttcac

SEQ ID NO: 21520 - DNA, 24 bp, Homo sapiens
gcacaaacacaaagttctggtcca

SEQ ID NO: 21521 - DNA, 24 bp, Homo sapiens
tttcacctgatactgtcccactgg

SEQ ID NO: 21522 - DNA, 24 bp, Homo sapiens
cgagggacctggcacgtacatccc

SEQ ID NO: 21523 - DNA, 24 bp, Homo sapiens
tcgagggacctggcacgtacatcc

SEQ ID NO: 21524 - DNA, 24 bp, Homo sapiens
ttcgagggacctggcacgtacatc

SEQ ID NO: 21525 - DNA, 23 bp, Homo sapiens
ccagagggtccagaaggtccgag

SEQ ID NO: 21526 - DNA, 24 bp, Homo sapiens
tggctgaggtggaggtgaagaagt

SEQ ID NO: 21527 - DNA, 23 bp, Homo sapiens
catcagggaccttgctgtggctg

SEQ ID NO: 21528 - DNA, 23 bp, Homo sapiens
agtgaagaagccagtggtgctgc

SEQ ID NO: 21529 - DNA, 25 bp, Homo sapiens
tccagtacgagttgaatcattgttc

SEQ ID NO: 21530 - DNA, 25 bp, Homo sapiens
tctggatctcgctcttctcgctcaa

SEQ ID NO: 21531 - DNA, 23 bp, Homo sapiens
cggcaagcatacagtcctcgtcg

SEQ ID NO: 21532 - DNA, 24 bp, Homo sapiens
ccgttcttcctccaaccatagccg

SEQ ID NO: 21533 - DNA, 24 bp, Homo sapiens
tcaccaaggtccaggagccattct

SEQ ID NO: 21534 - DNA, 24 bp, Homo sapiens
aacgatcctcctgcctcagtctcc

SEQ ID NO: 21535 - DNA, 23 bp, Homo sapiens
ccaggctggagtgcagtgatgaa

SEQ ID NO: 21536 - DNA, 24 bp, Homo sapiens
gctcattatagcctcaaactcctg

SEQ ID NO: 21537 - DNA, 24 bp, Homo sapiens
ccaactgttagacgacggacataa

SEQ ID NO: 21538 - DNA, 24 bp, Homo sapiens
gccaactgttagacgacggacata

SEQ ID NO: 21539 - DNA, 24 bp, Homo sapiens
agccaactgttagacgacggacat

SEQ ID NO: 21540 - DNA, 24 bp, Homo sapiens
aacagcacaaggtgtggcgaaagt

SEQ ID NO: 21541 - DNA, 24 bp, Homo sapiens
aaacagcacaaggtgtggcgaaag

SEQ ID NO: 21542 - DNA, 24 bp, Homo sapiens
gaaacagcacaaggtgtggcgaaa

SEQ ID NO: 21543 - DNA, 24 bp, Homo sapiens
tgtcatcgaggacctgagtcagaa

SEQ ID NO: 21544 - DNA, 24 bp, Homo sapiens
atgtcatcgaggacctgagtcaga

SEQ ID NO: 21545 - DNA, 24 bp, Homo sapiens
gatgtcatcgaggacctgagtcag

SEQ ID NO: 21546 - DNA, 25 bp, Homo sapiens
gaactccatcacaggggaacacagc

SEQ ID NO: 21547 - DNA, 25 bp, Homo sapiens
gcagcatacggatcttcacagtagc

SEQ ID NO: 21548 - DNA, 25 bp, Homo sapiens
gacctagccaccttcctatatcact

SEQ ID NO: 21549 - DNA, 24 bp, Homo sapiens
ggcggaggtagaagtggtggagat

SEQ ID NO: 21550 - DNA, 23 bp, Homo sapiens
ctgaagcagcctcaaactcctgg

SEQ ID NO: 21551 - DNA, 23 bp, Homo sapiens
gccttccttctgcctcaggctcc

SEQ ID NO: 21552 - DNA, 25 bp, Homo sapiens
agtgttgggattataggtgtgagcc

SEQ ID NO: 21553 - DNA, 23 bp, Homo sapiens
tcaagcaattctcctgccttggc

SEQ ID NO: 21554 - DNA, 23 bp, Homo sapiens
ttccccaggatggcctcaaactt

SEQ ID NO: 21555 - DNA, 23 bp, Homo sapiens
ggcgacttgcgaggatgagagcg

SEQ ID NO: 21556 - DNA, 23 bp, Homo sapiens
cttcctgctgctcttcctgctcg

SEQ ID NO: 21557 - DNA, 25 bp, Homo sapiens
cgatgaacggaggataaatggtgcc

SEQ ID NO: 21558 - DNA, 23 bp, Homo sapiens
ctactctcccgcctcagcctcct

SEQ ID NO: 21559 - DNA, 23 bp, Homo sapiens
agtggtgcaatcttggctcgctg

SEQ ID NO: 21560 - DNA, 24 bp, Homo sapiens
accctggcaacaaggtgaccctca

SEQ ID NO: 21561 - DNA, 24 bp, Homo sapiens
tacccaggagcagcaccagcccag

SEQ ID NO: 21562 - DNA, 24 bp, Homo sapiens
cgctaccggctgcatgacaaccaa

SEQ ID NO: 21563 - DNA, 24 bp, Homo sapiens
attcttgctagattttcaaaacat

SEQ ID NO: 21564 - DNA, 24 bp, Homo sapiens
aattcttgctagattttcaaaaca

SEQ ID NO: 21565 - DNA, 24 bp, Homo sapiens
taattcttgctagattttcaaaac

SEQ ID NO: 21566 - DNA, 24 bp, Homo sapiens
gcatgccagagggagatcttgtat

SEQ ID NO: 21567 - DNA, 24 bp, Homo sapiens
ggcatgccagagggagatcttgta

SEQ ID NO: 21568 - DNA, 24 bp, Homo sapiens
aggcatgccagagggagatcttgt

SEQ ID NO: 21569 - DNA, 24 bp, Homo sapiens
ccctccaacagtgggccccactgg

SEQ ID NO: 21570 - DNA, 24 bp, Homo sapiens
cccctccaacagtgggccccactg

SEQ ID NO: 21571 - DNA, 24 bp, Homo sapiens
acccctccaacagtgggccccact

SEQ ID NO: 21572 - DNA, 24 bp, Homo sapiens
ccagcagacagccaggtgaatgtg

SEQ ID NO: 21573 - DNA, 24 bp, Homo sapiens
cccagcagacagccaggtgaatgt

SEQ ID NO: 21574 - DNA, 24 bp, Homo sapiens
tcccagcagacagccaggtgaatg

SEQ ID NO: 21575 - DNA, 25 bp, Homo sapiens
ggagaccaaagcctatacaacccaa

SEQ ID NO: 21576 - DNA, 25 bp, Homo sapiens
aaggagaaagtggcacgaagagaga

SEQ ID NO: 21577 - DNA, 24 bp, Homo sapiens
aatagcacctgcgaatatggagcg

SEQ ID NO: 21578 - DNA, 24 bp, Homo sapiens
taccatcaccacccaccctgagag

SEQ ID NO: 21579 - DNA, 24 bp, Homo sapiens
ggcgtgccacctaccttatcatgg

SEQ ID NO: 21580 - DNA, 24 bp, Homo sapiens
tgacggtcactgatctggacgccc

SEQ ID NO: 21581 - DNA, 24 bp, Homo sapiens
gaccacagcagcccatttggaagc

SEQ ID NO: 21582 - DNA, 24 bp, Homo sapiens
ggaccacagcagcccatttggaag

SEQ ID NO: 21583 - DNA, 24 bp, Homo sapiens
aggaccacagcagcccatttggaa

SEQ ID NO: 21584 - DNA, 23 bp, Homo sapiens
tcttctcctagaaaagaaacttc

SEQ ID NO: 21585 - DNA, 25 bp, Homo sapiens
gagtcttggcagtcctttgctccat

SEQ ID NO: 21586 - DNA, 25 bp, Homo sapiens
agagaagactttctgggatctgaaa

SEQ ID NO: 21587 - DNA, 24 bp, Homo sapiens
cttggaaccaggtggggatgcggg

SEQ ID NO: 21588 - DNA, 24 bp, Homo sapiens
ccttggaaccaggtggggatgcgg

SEQ ID NO: 21589 - DNA, 24 bp, Homo sapiens
gccttggaaccaggtggggatgcg

SEQ ID NO: 21590 - DNA, 25 bp, Homo sapiens
tcctagcagacacctacgactcagt

SEQ ID NO: 21591 - DNA, 24 bp, Homo sapiens
ccgaactcatactcctgtgcctgc

SEQ ID NO: 21592 - DNA, 23 bp, Homo sapiens
gctctgtcctcaggctggtggat

SEQ ID NO: 21593 - DNA, 25 bp, Homo sapiens
caccacggtaatggaactcagcaca

SEQ ID NO: 21594 - DNA, 23 bp, Homo sapiens
ttcaactctgtggctgtggctgc

SEQ ID NO: 21595 - DNA, 23 bp, Homo sapiens
caggacaccacgcagagcaggat

SEQ ID NO: 21596 - DNA, 23 bp, Homo sapiens
ctggtcctggtggctgctggatt

SEQ ID NO: 21597 - DNA, 25 bp, Homo sapiens
gctgactacattgctgctttcctgc

SEQ ID NO: 21598 - DNA, 25 bp, Homo sapiens
gccaaggatataccatcaatgtgcc

SEQ ID NO: 21599 - DNA, 24 bp, Homo sapiens
ctgtctctggagggtggctacaac

SEQ ID NO: 21600 - DNA, 23 bp, Homo sapiens
ctggtcctggtggctgctggatt

SEQ ID NO: 21601 - DNA, 25 bp, Homo sapiens
gctgactacattgctgctttcctgc

SEQ ID NO: 21602 - DNA, 23 bp, Homo sapiens
ctgacaccgcgccctgccacaga

SEQ ID NO: 21603 - DNA, 23 bp, Homo sapiens
tggaggagctgggccttgccggg

SEQ ID NO: 21604 - DNA, 23 bp, Homo sapiens
ccagcgcatcttgcggatcatgt

SEQ ID NO: 21605 - DNA, 24 bp, Homo sapiens
tcagtgtagaggtaaggggtggga

SEQ ID NO: 21606 - DNA, 24 bp, Homo sapiens
ctcagtgtagaggtaaggggtggg

SEQ ID NO: 21607 - DNA, 24 bp, Homo sapiens
gctcagtgtagaggtaaggggtgg

SEQ ID NO: 21608 - DNA, 24 bp, Homo sapiens
cttttaacaaggtctcacatcagg

SEQ ID NO: 21609 - DNA, 24 bp, Homo sapiens
tcttttaacaaggtctcacatcag

SEQ ID NO: 21610 - DNA, 24 bp, Homo sapiens
ttcttttaacaaggtctcacatca

SEQ ID NO: 21611 - DNA, 24 bp, Homo sapiens
gaaatttactgatctgtttgagaa

SEQ ID NO: 21612 - DNA, 24 bp, Homo sapiens
agaaatttactgatctgtttgaga

SEQ ID NO: 21613 - DNA, 24 bp, Homo sapiens
cagaaatttactgatctgtttgag

SEQ ID NO: 21614 - DNA, 24 bp, Homo sapiens
ctagccaaattgcagcagaacaga

SEQ ID NO: 21615 - DNA, 25 bp, Homo sapiens
gagctgtgtgttgttcaattgtgca

SEQ ID NO: 21616 - DNA, 23 bp, Homo sapiens
ataatgatgaaggattgaaaatc

SEQ ID NO: 21617 - DNA, 24 bp, Homo sapiens
tcagcatgaaggtaaaataactcc

SEQ ID NO: 21618 - DNA, 24 bp, Homo sapiens
gtcagcatgaaggtaaaataactc

SEQ ID NO: 21619 - DNA, 24 bp, Homo sapiens
agtcagcatgaaggtaaaataact

SEQ ID NO: 21620 - DNA, 23 bp, Homo sapiens
atgatgctcctgctctgccactg

SEQ ID NO: 21621 - DNA, 25 bp, Homo sapiens
caacaacatggtgaacaactcctgg

SEQ ID NO: 21622 - DNA, 23 bp, Homo sapiens
gccacctgctacgccatgttcat

SEQ ID NO: 21623 - DNA, 23 bp, Homo sapiens
atgatgctcctgctctgccactg

SEQ ID NO: 21624 - DNA, 23 bp, Homo sapiens
gcctcttacgcctgttacgcctc

SEQ ID NO: 21625 - DNA, 25 bp, Homo sapiens
ttcctcattgtggagacacgcatcg

SEQ ID NO: 21626 - DNA, 23 bp, Homo sapiens
cctccacaaagtccagcacgacc

SEQ ID NO: 21627 - DNA, 25 bp, Homo sapiens
cggcgtcttcaactaccaggagaat

SEQ ID NO: 21628 - DNA, 23 bp, Homo sapiens
gctgccgctgccaccacttctgt

SEQ ID NO: 21629 - DNA, 24 bp, Homo sapiens
tgcccagacagaggctccagggac

SEQ ID NO: 21630 - DNA, 24 bp, Homo sapiens
ctgcccagacagaggctccaggga

SEQ ID NO: 21631 - DNA, 24 bp, Homo sapiens
cctgcccagacagaggctccaggg

SEQ ID NO: 21632 - DNA, 23 bp, Homo sapiens
aggcaccaggcagagacatcaca

SEQ ID NO: 21633 - DNA, 24 bp, Homo sapiens
aaccaccgctcaatattcaacgcc

SEQ ID NO: 21634 - DNA, 23 bp, Homo sapiens
gccgtggaccaggagaaccaaga

SEQ ID NO: 21635 - DNA, 24 bp, Homo sapiens
gttaatacaaggtaattatttgga

SEQ ID NO: 21636 - DNA, 24 bp, Homo sapiens
agttaatacaaggtaattatttgg

SEQ ID NO: 21637 - DNA, 24 bp, Homo sapiens
aagttaatacaaggtaattatttg

SEQ ID NO: 21638 - DNA, 24 bp, Homo sapiens
acatgctgctggtgctggcggaca

SEQ ID NO: 21639 - DNA, 24 bp, Homo sapiens
gacatgctgctggtgctggcggac

SEQ ID NO: 21640 - DNA, 24 bp, Homo sapiens
ggacatgctgctggtgctggcgga

SEQ ID NO: 21641 - DNA, 24 bp, Homo sapiens
aaatgttgaaggtgaatatatttt

SEQ ID NO: 21642 - DNA, 24 bp, Homo sapiens
aaaatgttgaaggtgaatatattt

SEQ ID NO: 21643 - DNA, 24 bp, Homo sapiens
aaaaatgttgaaggtgaatatatt

SEQ ID NO: 21644 - DNA, 24 bp, Homo sapiens
attaaaaaggcatatcggaaactg

SEQ ID NO: 21645 - DNA, 24 bp, Homo sapiens
tattaaaaaggcatatcggaaact

SEQ ID NO: 21646 - DNA, 24 bp, Homo sapiens
atattaaaaaggcatatcggaaac

SEQ ID NO: 21647 - DNA, 24 bp, Homo sapiens
cactgtctctctgaggaggagggc

SEQ ID NO: 21648 - DNA, 23 bp, Homo sapiens
gccagaacgccctgccagcccag

SEQ ID NO: 21649 - DNA, 23 bp, Homo sapiens
gcctccgcccgccgaagccgccc

SEQ ID NO: 21650 - DNA, 24 bp, Homo sapiens
aacaataaatggattgaaagaagg

SEQ ID NO: 21651 - DNA, 24 bp, Homo sapiens
taacaataaatggattgaaagaag

SEQ ID NO: 21652 - DNA, 24 bp, Homo sapiens
ttaacaataaatggattgaaagaa

SEQ ID NO: 21653 - DNA, 24 bp, Homo sapiens
agataacaaaggtaatgtattaat

SEQ ID NO: 21654 - DNA, 24 bp, Homo sapiens
aagataacaaaggtaatgtattaa

SEQ ID NO: 21655 - DNA, 24 bp, Homo sapiens
aaagataacaaaggtaatgtatta

SEQ ID NO: 21656 - DNA, 24 bp, Homo sapiens
aatttctgtagttaaacagggtaa

SEQ ID NO: 21657 - DNA, 24 bp, Homo sapiens
taatttctgtagttaaacagggta

SEQ ID NO: 21658 - DNA, 24 bp, Homo sapiens
ttaatttctgtagttaaacagggt

SEQ ID NO: 21659 - DNA, 24 bp, Homo sapiens
ggactatctggctgtgacacctgt

SEQ ID NO: 21660 - DNA, 24 bp, Homo sapiens
cagcctgggcaacatagcaagacc

SEQ ID NO: 21661 - DNA, 25 bp, Homo sapiens
actgaatgtgttagctcatgcctgt

SEQ ID NO: 21662 - DNA, 24 bp, Homo sapiens
acaaagtcaaggtaaagaatacat

SEQ ID NO: 21663 - DNA, 24 bp, Homo sapiens
tacaaagtcaaggtaaagaataca

SEQ ID NO: 21664 - DNA, 24 bp, Homo sapiens
gtacaaagtcaaggtaaagaatac

SEQ ID NO: 21665 - DNA, 24 bp, Homo sapiens
tttttaccaaggagaagaaacgaa

SEQ ID NO: 21666 - DNA, 24 bp, Homo sapiens
ctttttaccaaggagaagaaacga

SEQ ID NO: 21667 - DNA, 24 bp, Homo sapiens
actttttaccaaggagaagaaacg

SEQ ID NO: 21668 - DNA, 24 bp, Homo sapiens
gagtttgtagaggagaaaactaaa

SEQ ID NO: 21669 - DNA, 24 bp, Homo sapiens
tgagtttgtagaggagaaaactaa

SEQ ID NO: 21670 - DNA, 24 bp, Homo sapiens
atgagtttgtagaggagaaaacta

SEQ ID NO: 21671 - DNA, 24 bp, Homo sapiens
ttctaatacagatgtaggtgcaaa

SEQ ID NO: 21672 - DNA, 24 bp, Homo sapiens
attctaatacagatgtaggtgcaa

SEQ ID NO: 21673 - DNA, 24 bp, Homo sapiens
gattctaatacagatgtaggtgca

SEQ ID NO: 21674 - DNA, 24 bp, Homo sapiens
ttcaaagaaagacagctaagatac

SEQ ID NO: 21675 - DNA, 24 bp, Homo sapiens
cttcaaagaaagacagctaagata

SEQ ID NO: 21676 - DNA, 24 bp, Homo sapiens
tcttcaaagaaagacagctaagat

SEQ ID NO: 21677 - DNA, 24 bp, Homo sapiens
aatcaatttacgaattagcttacc

SEQ ID NO: 21678 - DNA, 24 bp, Homo sapiens
gaatcaatttacgaattagcttac

SEQ ID NO: 21679 - DNA, 24 bp, Homo sapiens
agaatcaatttacgaattagctta

SEQ ID NO: 21680 - DNA, 23 bp, Homo sapiens
gccaaccgcaccaccatcgtagt

SEQ ID NO: 21681 - DNA, 25 bp, Homo sapiens
aggctctcaactgtggtcaatgctg

SEQ ID NO: 21682 - DNA, 23 bp, Homo sapiens
gaggctctgttgtcccgaggtgg

SEQ ID NO: 21683 - DNA, 24 bp, Homo sapiens
caaatgaaatggtccataacttag

SEQ ID NO: 21684 - DNA, 24 bp, Homo sapiens
acaaatgaaatggtccataactta

SEQ ID NO: 21685 - DNA, 24 bp, Homo sapiens
tacaaatgaaatggtccataactt

SEQ ID NO: 21686 - DNA, 24 bp, Homo sapiens
gtagttaacaggttagcagttaga

SEQ ID NO: 21687 - DNA, 24 bp, Homo sapiens
agtagttaacaggttagcagttag

SEQ ID NO: 21688 - DNA, 24 bp, Homo sapiens
gagtagttaacaggttagcagtta

SEQ ID NO: 21689 - DNA, 24 bp, Homo sapiens
tatatttgatgatttaatttagat

SEQ ID NO: 21690 - DNA, 24 bp, Homo sapiens
atatatttgatgatttaatttaga

SEQ ID NO: 21691 - DNA, 24 bp, Homo sapiens
gatatatttgatgatttaatttag

SEQ ID NO: 21692 - DNA, 24 bp, Homo sapiens
acccacaacgtgtgcaccctgaca

SEQ ID NO: 21693 - DNA, 24 bp, Homo sapiens
gacccacaacgtgtgcaccctgac

SEQ ID NO: 21694 - DNA, 24 bp, Homo sapiens
ggacccacaacgtgtgcaccctga

SEQ ID NO: 21695 - DNA, 23 bp, Homo sapiens
ctggaggagctggatgccgacaa

SEQ ID NO: 21696 - DNA, 24 bp, Homo sapiens
atgaggatgcggagtgtgagaagc

SEQ ID NO: 21697 - DNA, 23 bp, Homo sapiens
gaagcgtgaagtgcccatccctg

SEQ ID NO: 21698 - DNA, 25 bp, Homo sapiens
agaaagagatgtccttgtggctggg

SEQ ID NO: 21699 - DNA, 24 bp, Homo sapiens
tgacattcctcctgactctgcggt

SEQ ID NO: 21700 - DNA, 23 bp, Homo sapiens
tcagagaggaagccaggatgccc

SEQ ID NO: 21701 - DNA, 24 bp, Homo sapiens
tgttaagcaaggaaaaacaaacaa

SEQ ID NO: 21702 - DNA, 24 bp, Homo sapiens
ttgttaagcaaggaaaaacaaaca

SEQ ID NO: 21703 - DNA, 24 bp, Homo sapiens
attgttaagcaaggaaaaacaaac

SEQ ID NO: 21704 - DNA, 24 bp, Homo sapiens
ttttccaaaaggcataataaaaac

SEQ ID NO: 21705 - DNA, 24 bp, Homo sapiens
tttttccaaaaggcataataaaaa

SEQ ID NO: 21706 - DNA, 24 bp, Homo sapiens
ctttttccaaaaggcataataaaa

SEQ ID NO: 21707 - DNA, 24 bp, Homo sapiens
ctgtcaaacaggtttcttttcact

SEQ ID NO: 21708 - DNA, 24 bp, Homo sapiens
actgtcaaacaggtttcttttcac

SEQ ID NO: 21709 - DNA, 24 bp, Homo sapiens
aactgtcaaacaggtttcttttca

SEQ ID NO: 21710 - DNA, 24 bp, Homo sapiens
cggaattggtgggttcttggtctc

SEQ ID NO: 21711 - DNA, 24 bp, Homo sapiens
tgtccctagcatttaccctattgt

SEQ ID NO: 21712 - DNA, 24 bp, Homo sapiens
ggctggagtgtagtggcaggatct

SEQ ID NO: 21713 - DNA, 24 bp, Homo sapiens
ctcactgcaacgtctgcctcttgg

SEQ ID NO: 21714 - DNA, 24 bp, Homo sapiens
agtgattattgtgattcaacctcc

SEQ ID NO: 21715 - DNA, 24 bp, Homo sapiens
aatttaataaacccaaaacaaagt

SEQ ID NO: 21716 - DNA, 24 bp, Homo sapiens
caatttaataaacccaaaacaaag

SEQ ID NO: 21717 - DNA, 24 bp, Homo sapiens
acaatttaataaacccaaaacaaa

SEQ ID NO: 21718 - DNA, 25 bp, Homo sapiens
acagtatgatgtgcctcaagagtgg

SEQ ID NO: 21719 - DNA, 23 bp, Homo sapiens
ctgtgatggcggtgctgctgctc

SEQ ID NO: 21720 - DNA, 24 bp, Homo sapiens
ttcaacatcgccaagagcctcgtg

SEQ ID NO: 21721 - DNA, 24 bp, Homo sapiens
ctcaagagtggcgaaaggaaggca

SEQ ID NO: 21722 - DNA, 24 bp, Homo sapiens
ctgtgatggcggtgctgctgctcg

SEQ ID NO: 21723 - DNA, 24 bp, Homo sapiens
ttcaacatcgccaagagcctcgtg

SEQ ID NO: 21724 - DNA, 23 bp, Homo sapiens
cctatgcagccaacagccaccag

SEQ ID NO: 21725 - DNA, 25 bp, Homo sapiens
atcgtggagagttacatcgggttca

SEQ ID NO: 21726 - DNA, 23 bp, Homo sapiens
ttcgtagctgtggtgaacaaggc

SEQ ID NO: 21727 - DNA, 24 bp, Homo sapiens
atagacttgagcatgaagtagatt

SEQ ID NO: 21728 - DNA, 24 bp, Homo sapiens
tatagacttgagcatgaagtagat

SEQ ID NO: 21729 - DNA, 24 bp, Homo sapiens
ttatagacttgagcatgaagtaga

SEQ ID NO: 21730 - DNA, 24 bp, Homo sapiens
actccgcctggccctgcctgcagt

SEQ ID NO: 21731 - DNA, 24 bp, Homo sapiens
aactccgcctggccctgcctgcag

SEQ ID NO: 21732 - DNA, 24 bp, Homo sapiens
caactccgcctggccctgcctgca

SEQ ID NO: 21733 - DNA, 24 bp, Homo sapiens
gctccttcctgccgcaagggcaaa

SEQ ID NO: 21734 - DNA, 24 bp, Homo sapiens
agctccttcctgccgcaagggcaa

SEQ ID NO: 21735 - DNA, 24 bp, Homo sapiens
cagctccttcctgccgcaagggca

SEQ ID NO: 21736 - DNA, 24 bp, Homo sapiens
cacagcacgaggcacagtgaaggt

SEQ ID NO: 21737 - DNA, 24 bp, Homo sapiens
tcacagcacgaggcacagtgaagg

SEQ ID NO: 21738 - DNA, 24 bp, Homo sapiens
ctcacagcacgaggcacagtgaag

SEQ ID NO: 21739 - DNA, 23 bp, Homo sapiens
ctggtggtggtctcgctggtcat

SEQ ID NO: 21740 - DNA, 25 bp, Homo sapiens
gcagatcatccgcttcctcctcttg

SEQ ID NO: 21741 - DNA, 23 bp, Homo sapiens
ctccagcacgattcctgagcagc

SEQ ID NO: 21742 - DNA, 23 bp, Homo sapiens
gctgctgctgtttgagtcggagt

SEQ ID NO: 21743 - DNA, 23 bp, Homo sapiens
gccatctccttcacctcgctgat

SEQ ID NO: 21744 - DNA, 25 bp, Homo sapiens
acttcatcgccaccttgtcattctt

SEQ ID NO: 21745 - DNA, 24 bp, Homo sapiens
ggataatgaaggtaaattttagaa

SEQ ID NO: 21746 - DNA, 24 bp, Homo sapiens
aggataatgaaggtaaattttaga

SEQ ID NO: 21747 - DNA, 24 bp, Homo sapiens
caggataatgaaggtaaattttag

SEQ ID NO: 21748 - DNA, 24 bp, Homo sapiens
cgaactcctgacctcaagtgatgc

SEQ ID NO: 21749 - DNA, 24 bp, Homo sapiens
ccatcgtgcatgagccagccagaa

SEQ ID NO: 21750 - DNA, 24 bp, Homo sapiens
atgtgagaactttgatgctgttga

SEQ ID NO: 21751 - DNA, 24 bp, Homo sapiens
gaaatttgacggtaggtgaaatgg

SEQ ID NO: 21752 - DNA, 24 bp, Homo sapiens
agaaatttgacggtaggtgaaatg

SEQ ID NO: 21753 - DNA, 24 bp, Homo sapiens
aagaaatttgacggtaggtgaaat

SEQ ID NO: 21754 - DNA, 25 bp, Homo sapiens
cggaaggagatggaacagattgtag

SEQ ID NO: 21755 - DNA, 23 bp, Homo sapiens
caggagcagcaggagatggagcg

SEQ ID NO: 21756 - DNA, 23 bp, Homo sapiens
agaagcggctggcgatggagtcc

SEQ ID NO: 21757 - DNA, 25 bp, Homo sapiens
ctaacctggatcacaaggaggctgt

SEQ ID NO: 21758 - DNA, 25 bp, Homo sapiens
cgcagcctgaccatctccattgtag

SEQ ID NO: 21759 - DNA, 23 bp, Homo sapiens
agaagcggctggcgatggagtcc

SEQ ID NO: 21760 - DNA, 24 bp, Homo sapiens
ctgtcagcacaacataaatgaatg

SEQ ID NO: 21761 - DNA, 24 bp, Homo sapiens
actgtcagcacaacataaatgaat

SEQ ID NO: 21762 - DNA, 24 bp, Homo sapiens
cactgtcagcacaacataaatgaa

SEQ ID NO: 21763 - DNA, 24 bp, Homo sapiens
aatggttacaggtaaagttttcca

SEQ ID NO: 21764 - DNA, 24 bp, Homo sapiens
caatggttacaggtaaagttttcc

SEQ ID NO: 21765 - DNA, 24 bp, Homo sapiens
acaatggttacaggtaaagttttc

SEQ ID NO: 21766 - DNA, 24 bp, Homo sapiens
ggctgttaatatcaggaatggtgc

SEQ ID NO: 21767 - DNA, 24 bp, Homo sapiens
gatgaagagcatgtctgcccaggt

SEQ ID NO: 21768 - DNA, 24 bp, Homo sapiens
ctcagcaggcagcaggaaaataga

SEQ ID NO: 21769 - DNA, 24 bp, Homo sapiens
gtgaaggaaagaaatcactgtgtt

SEQ ID NO: 21770 - DNA, 24 bp, Homo sapiens
ggtgaaggaaagaaatcactgtgt

SEQ ID NO: 21771 - DNA, 24 bp, Homo sapiens
aggtgaaggaaagaaatcactgtg

SEQ ID NO: 21772 - DNA, 24 bp, Homo sapiens
aaaatgaacaaatggaactgatta

SEQ ID NO: 21773 - DNA, 24 bp, Homo sapiens
aaaaatgaacaaatggaactgatt

SEQ ID NO: 21774 - DNA, 24 bp, Homo sapiens
taaaaatgaacaaatggaactgat

SEQ ID NO: 21775 - DNA, 25 bp, Homo sapiens
cggaagtggaagtcaggagtagcaa

SEQ ID NO: 21776 - DNA, 25 bp, Homo sapiens
tgaccatcagcaggaatgagaagga

SEQ ID NO: 21777 - DNA, 24 bp, Homo sapiens
tgagggctccatcaactctgtccg

SEQ ID NO: 21778 - DNA, 23 bp, Homo sapiens
tgggcaagaaagcagcagtggac

SEQ ID NO: 21779 - DNA, 24 bp, Homo sapiens
ttattggttgctgtgggtctgggc

SEQ ID NO: 21780 - DNA, 23 bp, Homo sapiens
atttgatgcgggaggtgggtggt

SEQ ID NO: 21781 - DNA, 25 bp, Homo sapiens
tgagtccttcaatgttccaggcttg

SEQ ID NO: 21782 - DNA, 24 bp, Homo sapiens
tcaagacaagtaggagaacggacg

SEQ ID NO: 21783 - DNA, 25 bp, Homo sapiens
acggtaatagacagtggagatggtg

SEQ ID NO: 21784 - DNA, 25 bp, Homo sapiens
ctgctgagagaccgagaagtaggaa

SEQ ID NO: 21785 - DNA, 25 bp, Homo sapiens
tgtggctgaagggtatgtgattggc

SEQ ID NO: 21786 - DNA, 25 bp, Homo sapiens
acggtaatagacagtggagatggtg

SEQ ID NO: 21787 - DNA, 24 bp, Homo sapiens
aatcttatacaatctgaattctac

SEQ ID NO: 21788 - DNA, 24 bp, Homo sapiens
gaatcttatacaatctgaattcta

SEQ ID NO: 21789 - DNA, 24 bp, Homo sapiens
tgaatcttatacaatctgaattct

SEQ ID NO: 21790 - DNA, 24 bp, Homo sapiens
ggtgcacgcagcgtccgggagcct

SEQ ID NO: 21791 - DNA, 24 bp, Homo sapiens
aggtgcacgcagcgtccgggagcc

SEQ ID NO: 21792 - DNA, 24 bp, Homo sapiens
gaggtgcacgcagcgtccgggagc

SEQ ID NO: 21793 - DNA, 24 bp, Homo sapiens
ctcgcgggcaggggtttcttccag

SEQ ID NO: 21794 - DNA, 24 bp, Homo sapiens
cctcgcgggcaggggtttcttcca

SEQ ID NO: 21795 - DNA, 24 bp, Homo sapiens
gcctcgcgggcaggggtttcttcc

SEQ ID NO: 21796 - DNA, 24 bp, Homo sapiens
aattgaaaaagcctttagattttg

SEQ ID NO: 21797 - DNA, 24 bp, Homo sapiens
aaattgaaaaagcctttagatttt

SEQ ID NO: 21798 - DNA, 24 bp, Homo sapiens
caaattgaaaaagcctttagattt

SEQ ID NO: 21799 - DNA, 24 bp, Homo sapiens
cgtcacagatgaggatacacaaga

SEQ ID NO: 21800 - DNA, 24 bp, Homo sapiens
tgagtcttcccctattggttcagc

SEQ ID NO: 21801 - DNA, 24 bp, Homo sapiens
aagaataagagctgtggatcctga

SEQ ID NO: 21802 - DNA, 23 bp, Homo sapiens
gcccgtctcagcctcccaaagtg

SEQ ID NO: 21803 - DNA, 25 bp, Homo sapiens
ggagtcttattccagaggagaagcc

SEQ ID NO: 21804 - DNA, 23 bp, Homo sapiens
ttacaggcgtgagccacggcgcc

SEQ ID NO: 21805 - DNA, 23 bp, Homo sapiens
gaccagcccagccccaggatgtg

SEQ ID NO: 21806 - DNA, 23 bp, Homo sapiens
cagcagctctgcctggttggcct

SEQ ID NO: 21807 - DNA, 23 bp, Homo sapiens
tcttgctctgtggcccaggccgg

SEQ ID NO: 21808 - DNA, 23 bp, Homo sapiens
aactgttggtccagcaagtagcc

SEQ ID NO: 21809 - DNA, 25 bp, Homo sapiens
gaggctgaagcaggtggatcacttg

SEQ ID NO: 21810 - DNA, 25 bp, Homo sapiens
ctgacagagaaggctcactcaagga

SEQ ID NO: 21811 - DNA, 24 bp, Homo sapiens
cctcagcagttccctctttcagaa

SEQ ID NO: 21812 - DNA, 23 bp, Homo sapiens
gtccctctgcctgcccactcagt

SEQ ID NO: 21813 - DNA, 23 bp, Homo sapiens
acccgggagctgttttgtccttt

SEQ ID NO: 21814 - DNA, 24 bp, Homo sapiens
caaatgaaaaggtatgcttttaaa

SEQ ID NO: 21815 - DNA, 24 bp, Homo sapiens
gcaaatgaaaaggtatgcttttaa

SEQ ID NO: 21816 - DNA, 24 bp, Homo sapiens
tgcaaatgaaaaggtatgctttta

SEQ ID NO: 21817 - DNA, 24 bp, Homo sapiens
actagaacaaagtaggtgtttata

SEQ ID NO: 21818 - DNA, 24 bp, Homo sapiens
tactagaacaaagtaggtgtttat

SEQ ID NO: 21819 - DNA, 24 bp, Homo sapiens
ttactagaacaaagtaggtgttta

SEQ ID NO: 21820 - DNA, 24 bp, Homo sapiens
accaactgatggcaagtattttga

SEQ ID NO: 21821 - DNA, 24 bp, Homo sapiens
aaccaactgatggcaagtattttg

SEQ ID NO: 21822 - DNA, 24 bp, Homo sapiens
caaccaactgatggcaagtatttt

SEQ ID NO: 21823 - DNA, 24 bp, Homo sapiens
tgttgaacaggaatgactttgcag

SEQ ID NO: 21824 - DNA, 24 bp, Homo sapiens
ttgttgaacaggaatgactttgca

SEQ ID NO: 21825 - DNA, 24 bp, Homo sapiens
cttgttgaacaggaatgactttgc

SEQ ID NO: 21826 - DNA, 24 bp, Homo sapiens
cagcagaaccggtcaaagcagaac

SEQ ID NO: 21827 - DNA, 24 bp, Homo sapiens
ccagcagaaccggtcaaagcagaa

SEQ ID NO: 21828 - DNA, 24 bp, Homo sapiens
accagcagaaccggtcaaagcaga

SEQ ID NO: 21829 - DNA, 24 bp, Homo sapiens
acttcagtcaggtatgttcatttg

SEQ ID NO: 21830 - DNA, 24 bp, Homo sapiens
aacttcagtcaggtatgttcattt

SEQ ID NO: 21831 - DNA, 24 bp, Homo sapiens
gaacttcagtcaggtatgttcatt

SEQ ID NO: 21832 - DNA, 24 bp, Homo sapiens
ggagattaaaggtaattcattaaa

SEQ ID NO: 21833 - DNA, 24 bp, Homo sapiens
tggagattaaaggtaattcattaa

SEQ ID NO: 21834 - DNA, 24 bp, Homo sapiens
ttggagattaaaggtaattcatta

SEQ ID NO: 21835 - DNA, 24 bp, Homo sapiens
aattctaaactatgtattctacta

SEQ ID NO: 21836 - DNA, 24 bp, Homo sapiens
caattctaaactatgtattctact

SEQ ID NO: 21837 - DNA, 24 bp, Homo sapiens
tcaattctaaactatgtattctac

SEQ ID NO: 21838 - DNA, 24 bp, Homo sapiens
aggctcaagatatggctggactgg

SEQ ID NO: 21839 - DNA, 24 bp, Homo sapiens
gctgcctacaccatcatcaacgga

SEQ ID NO: 21840 - DNA, 24 bp, Homo sapiens
tccacaccaaccctcaaaccaacg

SEQ ID NO: 21841 - DNA, 24 bp, Homo sapiens
ggagcccttgaaggcgacatcttc

SEQ ID NO: 21842 - DNA, 24 bp, Homo sapiens
aaaactgtatagggcatatgatat

SEQ ID NO: 21843 - DNA, 24 bp, Homo sapiens
taaaactgtatagggcatatgata

SEQ ID NO: 21844 - DNA, 24 bp, Homo sapiens
ctaaaactgtatagggcatatgat

SEQ ID NO: 21845 - DNA, 24 bp, Homo sapiens
tgattctgctgtgaaatcaaatac

SEQ ID NO: 21846 - DNA, 24 bp, Homo sapiens
ctgattctgctgtgaaatcaaata

SEQ ID NO: 21847 - DNA, 24 bp, Homo sapiens
tctgattctgctgtgaaatcaaat

SEQ ID NO: 21848 - DNA, 24 bp, Homo sapiens
ttatttgaaagtaataacatagat

SEQ ID NO: 21849 - DNA, 24 bp, Homo sapiens
attatttgaaagtaataacataga

SEQ ID NO: 21850 - DNA, 24 bp, Homo sapiens
gattatttgaaagtaataacatag

SEQ ID NO: 21851 - DNA, 24 bp, Homo sapiens
aaatcaaaaaggtacatttctttt

SEQ ID NO: 21852 - DNA, 24 bp, Homo sapiens
taaatcaaaaaggtacatttcttt

SEQ ID NO: 21853 - DNA, 24 bp, Homo sapiens
ataaatcaaaaaggtacatttctt

SEQ ID NO: 21854 - DNA, 24 bp, Homo sapiens
gatggacgccgcgttcctcctcgt

SEQ ID NO: 21855 - DNA, 24 bp, Homo sapiens
gcactccggcccggctcccgcctc

SEQ ID NO: 21856 - DNA, 24 bp, Homo sapiens
cactcagcctggacgcgcttcttc

SEQ ID NO: 21857 - DNA, 24 bp, Homo sapiens
ctgcctccactgcactcagccaca

SEQ ID NO: 21858 - DNA, 24 bp, Homo sapiens
gctgcctccactgcactcagccac

SEQ ID NO: 21859 - DNA, 24 bp, Homo sapiens
ggctgcctccactgcactcagcca

SEQ ID NO: 21860 - DNA, 23 bp, Homo sapiens
gcctgcggcctttgctgcgggcg

SEQ ID NO: 21861 - DNA, 23 bp, Homo sapiens
gagctgcgggcgctgctgctgtg

SEQ ID NO: 21862 - DNA, 25 bp, Homo sapiens
ccaggttcaagcgattctagtgcgt

SEQ ID NO: 21863 - DNA, 23 bp, Homo sapiens
gcattagtcgtgctgtcgcctag

SEQ ID NO: 21864 - DNA, 25 bp, Homo sapiens
agaatccttcgtctatgaagtgtcc

SEQ ID NO: 21865 - DNA, 23 bp, Homo sapiens
gaaggaggtggtggctgcgttgg

SEQ ID NO: 21866 - DNA, 24 bp, Homo sapiens
ggggtaattcggggtctgggttct

SEQ ID NO: 21867 - DNA, 23 bp, Homo sapiens
ccgttcgggctggggctgtcggc

SEQ ID NO: 21868 - DNA, 24 bp, Homo sapiens
tcctgccccagccctgactcttgc

SEQ ID NO: 21869 - DNA, 24 bp, Homo sapiens
ctcctgccccagccctgactcttg

SEQ ID NO: 21870 - DNA, 24 bp, Homo sapiens
cctcctgccccagccctgactctt

SEQ ID NO: 21871 - DNA, 24 bp, Homo sapiens
atggtccctgcctggctgtggctg

SEQ ID NO: 21872 - DNA, 24 bp, Homo sapiens
caagggagccagtcttgggcgctg

SEQ ID NO: 21873 - DNA, 24 bp, Homo sapiens
aggagctctcttcttgcttggcag

SEQ ID NO: 21874 - DNA, 24 bp, Homo sapiens
attttttacaggtaaaatgtttaa

SEQ ID NO: 21875 - DNA, 24 bp, Homo sapiens
tattttttacaggtaaaatgttta

SEQ ID NO: 21876 - DNA, 24 bp, Homo sapiens
ttattttttacaggtaaaatgttt

SEQ ID NO: 21877 - DNA, 24 bp, Homo sapiens
ggaagacattggtaaattttgatc

SEQ ID NO: 21878 - DNA, 24 bp, Homo sapiens
tggaagacattggtaaattttgat

SEQ ID NO: 21879 - DNA, 24 bp, Homo sapiens
ttggaagacattggtaaattttga

SEQ ID NO: 21880 - DNA, 24 bp, Homo sapiens
ttttctttcagttacaagaatttg

SEQ ID NO: 21881 - DNA, 24 bp, Homo sapiens
attttctttcagttacaagaattt

SEQ ID NO: 21882 - DNA, 24 bp, Homo sapiens
tattttctttcagttacaagaatt

SEQ ID NO: 21883 - DNA, 24 bp, Homo sapiens
agaaaataaaggtttatgatagtt

SEQ ID NO: 21884 - DNA, 24 bp, Homo sapiens
aagaaaataaaggtttatgatagt

SEQ ID NO: 21885 - DNA, 24 bp, Homo sapiens
aaagaaaataaaggtttatgatag

SEQ ID NO: 21886 - DNA, 24 bp, Homo sapiens
agaagtacagaaatcaaaactaaa

SEQ ID NO: 21887 - DNA, 24 bp, Homo sapiens
aagaagtacagaaatcaaaactaa

SEQ ID NO: 21888 - DNA, 24 bp, Homo sapiens
gaagaagtacagaaatcaaaacta

SEQ ID NO: 21889 - DNA, 24 bp, Homo sapiens
aaatcactcaggtgcggtggaatg

SEQ ID NO: 21890 - DNA, 24 bp, Homo sapiens
aaaatcactcaggtgcggtggaat

SEQ ID NO: 21891 - DNA, 24 bp, Homo sapiens
caaaatcactcaggtgcggtggaa

SEQ ID NO: 21892 - DNA, 24 bp, Homo sapiens
atggagtaaagatttgattggaag

SEQ ID NO: 21893 - DNA, 24 bp, Homo sapiens
catggagtaaagatttgattggaa

SEQ ID NO: 21894 - DNA, 24 bp, Homo sapiens
acatggagtaaagatttgattgga

SEQ ID NO: 21895 - DNA, 24 bp, Homo sapiens
gaaacataaataaagaaaatgaca

SEQ ID NO: 21896 - DNA, 24 bp, Homo sapiens
ggaaacataaataaagaaaatgac

SEQ ID NO: 21897 - DNA, 24 bp, Homo sapiens
aggaaacataaataaagaaaatga

SEQ ID NO: 21898 - DNA, 23 bp, Homo sapiens
ggaggcgagcaggcagcagttgg

SEQ ID NO: 21899 - DNA, 23 bp, Homo sapiens
ttcggcggcggctgaggaagaag

SEQ ID NO: 21900 - DNA, 23 bp, Homo sapiens
cggttgtgcttgtgcttgtggcg

SEQ ID NO: 21901 - DNA, 24 bp, Homo sapiens
ctgagtcgcaccagtgagaccaac

SEQ ID NO: 21902 - DNA, 23 bp, Homo sapiens
ggacttcctggacctgctcttcc

SEQ ID NO: 21903 - DNA, 23 bp, Homo sapiens
gccacgaacctgctcaagctctt

SEQ ID NO: 21904 - DNA, 25 bp, Homo sapiens
ctgagcatgatgtgttgaaggaagc

SEQ ID NO: 21905 - DNA, 24 bp, Homo sapiens
agttggaggctgctgaatggttgg

SEQ ID NO: 21906 - DNA, 25 bp, Homo sapiens
aacaagttcctcaggcagagtccat

SEQ ID NO: 21907 - DNA, 24 bp, Homo sapiens
caggaggagccggagcctgcacac

SEQ ID NO: 21908 - DNA, 24 bp, Homo sapiens
ccaggaggagccggagcctgcaca

SEQ ID NO: 21909 - DNA, 24 bp, Homo sapiens
gccaggaggagccggagcctgcac

SEQ ID NO: 21910 - DNA, 24 bp, Homo sapiens
tgatttaaaagatagactgaagag

SEQ ID NO: 21911 - DNA, 24 bp, Homo sapiens
gtgatttaaaagatagactgaaga

SEQ ID NO: 21912 - DNA, 24 bp, Homo sapiens
agtgatttaaaagatagactgaag

SEQ ID NO: 21913 - DNA, 24 bp, Homo sapiens
tgagagaaaaggttttcaaaaatg

SEQ ID NO: 21914 - DNA, 24 bp, Homo sapiens
ttgagagaaaaggttttcaaaaat

SEQ ID NO: 21915 - DNA, 24 bp, Homo sapiens
attgagagaaaaggttttcaaaaa

SEQ ID NO: 21916 - DNA, 24 bp, Homo sapiens
ctggggagagatgatggtgtctgc

SEQ ID NO: 21917 - DNA, 24 bp, Homo sapiens
ggagccagttacagatctatccca

SEQ ID NO: 21918 - DNA, 24 bp, Homo sapiens
atagactgaagaggagcaagaaca

SEQ ID NO: 21919 - DNA, 24 bp, Homo sapiens
cacctttgatggctcggacctcag

SEQ ID NO: 21920 - DNA, 23 bp, Homo sapiens
ctccccacccaccccgcctgctc

SEQ ID NO: 21921 - DNA, 23 bp, Homo sapiens
cttgggagccgccgatcccggag

SEQ ID NO: 21922 - DNA, 24 bp, Homo sapiens
acctttccgagctgtctgtgaact

SEQ ID NO: 21923 - DNA, 23 bp, Homo sapiens
accttgtctcccaacctgagccc

SEQ ID NO: 21924 - DNA, 23 bp, Homo sapiens
cggacggacgatgaggatgaggg

SEQ ID NO: 21925 - DNA, 25 bp, Homo sapiens
accaccgagcgaacatatctgaagg

SEQ ID NO: 21926 - DNA, 23 bp, Homo sapiens
cggacggacgatgaggatgaggg

SEQ ID NO: 21927 - DNA, 23 bp, Homo sapiens
accttgtctcccaacctgagccc

SEQ ID NO: 21928 - DNA, 23 bp, Homo sapiens
aggcgtcttgctttgtcacccac

SEQ ID NO: 21929 - DNA, 23 bp, Homo sapiens
ctcaccgcaacctccacctcctg

SEQ ID NO: 21930 - DNA, 25 bp, Homo sapiens
gggaaactcttgtgggaggagcaga

SEQ ID NO: 21931 - DNA, 24 bp, Homo sapiens
catgaggtcactctgcacggtcac

SEQ ID NO: 21932 - DNA, 25 bp, Homo sapiens
ggcgactttgtcagtaccccaaact

SEQ ID NO: 21933 - DNA, 23 bp, Homo sapiens
ccacatcgccagccgcacccctc

SEQ ID NO: 21934 - DNA, 24 bp, Homo sapiens
actgtagcgtccttcgtggcattg

SEQ ID NO: 21935 - DNA, 25 bp, Homo sapiens
agttctacgaggagtgaccaatgat

SEQ ID NO: 21936 - DNA, 23 bp, Homo sapiens
cggaggaggaggcgaagtggttt

SEQ ID NO: 21937 - DNA, 25 bp, Homo sapiens
tggacacggacacggatcttcatct

SEQ ID NO: 21938 - DNA, 25 bp, Homo sapiens
aacctgtggagtctgttactgttct

SEQ ID NO: 21939 - DNA, 25 bp, Homo sapiens
ctgtgcttcctcagcctactatcat

SEQ ID NO: 21940 - DNA, 24 bp, Homo sapiens
ccaactcgcaatactactataatt

SEQ ID NO: 21941 - DNA, 24 bp, Homo sapiens
cccaactcgcaatactactataat

SEQ ID NO: 21942 - DNA, 24 bp, Homo sapiens
ccccaactcgcaatactactataa

SEQ ID NO: 21943 - DNA, 25 bp, Homo sapiens
gagtcggcagatgatggtgatggtg

SEQ ID NO: 21944 - DNA, 25 bp, Homo sapiens
ttccgacctcatctccaggacagtg

SEQ ID NO: 21945 - DNA, 23 bp, Homo sapiens
ggcaagcctgtgtccttcggtac

SEQ ID NO: 21946 - DNA, 24 bp, Homo sapiens
cagcagaaacagtgtaaaatacta

SEQ ID NO: 21947 - DNA, 24 bp, Homo sapiens
acagcagaaacagtgtaaaatact

SEQ ID NO: 21948 - DNA, 24 bp, Homo sapiens
aacagcagaaacagtgtaaaatac

SEQ ID NO: 21949 - DNA, 24 bp, Homo sapiens
cgtgttggactcagggctttaggc

SEQ ID NO: 21950 - DNA, 25 bp, Homo sapiens
aatataggatggctttctgtaccgc

SEQ ID NO: 21951 - DNA, 23 bp, Homo sapiens
ctcagcccagcccccaactcccg

SEQ ID NO: 21952 - DNA, 24 bp, Homo sapiens
tgtccattcagatattatattaca

SEQ ID NO: 21953 - DNA, 24 bp, Homo sapiens
gtgtccattcagatattatattac

SEQ ID NO: 21954 - DNA, 24 bp, Homo sapiens
ggtgtccattcagatattatatta

SEQ ID NO: 21955 - DNA, 24 bp, Homo sapiens
tgtagcctagggcaccgttcacct

SEQ ID NO: 21956 - DNA, 24 bp, Homo sapiens
ctgtagcctagggcaccgttcacc

SEQ ID NO: 21957 - DNA, 24 bp, Homo sapiens
cctgtagcctagggcaccgttcac

SEQ ID NO: 21958 - DNA, 24 bp, Homo sapiens
aaagagaaagaaaattgatgcttc

SEQ ID NO: 21959 - DNA, 24 bp, Homo sapiens
taaagagaaagaaaattgatgctt

SEQ ID NO: 21960 - DNA, 24 bp, Homo sapiens
ttaaagagaaagaaaattgatgct

SEQ ID NO: 21961 - DNA, 23 bp, Homo sapiens
tcttgctgctgctcactcgttgg

SEQ ID NO: 21962 - DNA, 25 bp, Homo sapiens
aagaaccgtaatactcaccgcaagg

SEQ ID NO: 21963 - DNA, 25 bp, Homo sapiens
gaagagactgtcacctatcaccaag

SEQ ID NO: 21964 - DNA, 24 bp, Homo sapiens
caattgtgcatcctatagaaaaca

SEQ ID NO: 21965 - DNA, 24 bp, Homo sapiens
acaattgtgcatcctatagaaaac

SEQ ID NO: 21966 - DNA, 24 bp, Homo sapiens
gacaattgtgcatcctatagaaaa

SEQ ID NO: 21967 - DNA, 24 bp, Homo sapiens
tatcaaaacagagtatctcccata

SEQ ID NO: 21968 - DNA, 24 bp, Homo sapiens
atatcaaaacagagtatctcccat

SEQ ID NO: 21969 - DNA, 24 bp, Homo sapiens
aatatcaaaacagagtatctccca

SEQ ID NO: 21970 - DNA, 24 bp, Homo sapiens
gctacagggtgaccaacgcaagaa

SEQ ID NO: 21971 - DNA, 25 bp, Homo sapiens
tccagatcagcaaggaatatgagcg

SEQ ID NO: 21972 - DNA, 24 bp, Homo sapiens
tgagcatccttctgaggtccagca

SEQ ID NO: 21973 - DNA, 25 bp, Homo sapiens
tggattacgatgaagaggaagagcc

SEQ ID NO: 21974 - DNA, 23 bp, Homo sapiens
atcttccgcctgacaccacacga

SEQ ID NO: 21975 - DNA, 24 bp, Homo sapiens
aggatgtgagtagggcgagagtgg

SEQ ID NO: 21976 - DNA, 23 bp, Homo sapiens
agcttggtccacacctgagtcgg

SEQ ID NO: 21977 - DNA, 25 bp, Homo sapiens
tggacagacttcttagacttggagg

SEQ ID NO: 21978 - DNA, 25 bp, Homo sapiens
ggaagttgtacctgccagaattagc

SEQ ID NO: 21979 - DNA, 23 bp, Homo sapiens
cccgcccgtcttcaggagagaaa

SEQ ID NO: 21980 - DNA, 24 bp, Homo sapiens
cttccatttagatcaatactataa

SEQ ID NO: 21981 - DNA, 24 bp, Homo sapiens
tcttccatttagatcaatactata

SEQ ID NO: 21982 - DNA, 24 bp, Homo sapiens
ctcttccatttagatcaatactat

SEQ ID NO: 21983 - DNA, 24 bp, Homo sapiens
ttaaattttaggtcattatttctg

SEQ ID NO: 21984 - DNA, 24 bp, Homo sapiens
cttaaattttaggtcattatttct

SEQ ID NO: 21985 - DNA, 24 bp, Homo sapiens
ccttaaattttaggtcattatttc

SEQ ID NO: 21986 - DNA, 24 bp, Homo sapiens
ctatacatcagtatgcagaccctg

SEQ ID NO: 21987 - DNA, 24 bp, Homo sapiens
actatacatcagtatgcagaccct

SEQ ID NO: 21988 - DNA, 24 bp, Homo sapiens
aactatacatcagtatgcagaccc

SEQ ID NO: 21989 - DNA, 24 bp, Homo sapiens
atataattggtctccttgatgctt

SEQ ID NO: 21990 - DNA, 24 bp, Homo sapiens
aatataattggtctccttgatgct

SEQ ID NO: 21991 - DNA, 24 bp, Homo sapiens
aaatataattggtctccttgatgc

SEQ ID NO: 21992 - DNA, 24 bp, Homo sapiens
ggcccagccagcctcaggtcagcc

SEQ ID NO: 21993 - DNA, 24 bp, Homo sapiens
tggcccagccagcctcaggtcagc

SEQ ID NO: 21994 - DNA, 24 bp, Homo sapiens
ctggcccagccagcctcaggtcag

SEQ ID NO: 21995 - DNA, 24 bp, Homo sapiens
tatatccctagacaatgtctttac

SEQ ID NO: 21996 - DNA, 24 bp, Homo sapiens
ttatatccctagacaatgtcttta

SEQ ID NO: 21997 - DNA, 24 bp, Homo sapiens
tttatatccctagacaatgtcttt

SEQ ID NO: 21998 - DNA, 24 bp, Homo sapiens
taccaaaaaatacaatgtctttac

SEQ ID NO: 21999 - DNA, 24 bp, Homo sapiens
ataccaaaaaatacaatgtcttta

SEQ ID NO: 22000 - DNA, 24 bp, Homo sapiens
gataccaaaaaatacaatgtcttt

SEQ ID NO: 22001 - DNA, 24 bp, Homo sapiens
ggatgccagtggagaagaggtaca

SEQ ID NO: 22002 - DNA, 25 bp, Homo sapiens
gcgtggtcatcgttgtctttctcgg

SEQ ID NO: 22003 - DNA, 23 bp, Homo sapiens
gccaggtcagagcagcccaccat

SEQ ID NO: 22004 - DNA, 23 bp, Homo sapiens
ggtgatgctgctgtgcctgatgg

SEQ ID NO: 22005 - DNA, 23 bp, Homo sapiens
gcagtcaaggcatggcggtcatt

SEQ ID NO: 22006 - DNA, 23 bp, Homo sapiens
ccctggaaatggcaccctggttt

SEQ ID NO: 22007 - DNA, 24 bp, Homo sapiens
aaaatagacaggcactgctgggag

SEQ ID NO: 22008 - DNA, 24 bp, Homo sapiens
aaaaatagacaggcactgctggga

SEQ ID NO: 22009 - DNA, 24 bp, Homo sapiens
aaaaaatagacaggcactgctggg

SEQ ID NO: 22010 - DNA, 25 bp, Homo sapiens
tgtatgacagagaacagaggatgcc

SEQ ID NO: 22011 - DNA, 24 bp, Homo sapiens
gctggaaattcatcacaacctgag

SEQ ID NO: 22012 - DNA, 23 bp, Homo sapiens
gatctgctctgtgccggtcctct

SEQ ID NO: 22013 - DNA, 24 bp, Homo sapiens
cgaagccttcggtgagtggctcgg

SEQ ID NO: 22014 - DNA, 24 bp, Homo sapiens
tcgaagccttcggtgagtggctcg

SEQ ID NO: 22015 - DNA, 24 bp, Homo sapiens
atcgaagccttcggtgagtggctc

SEQ ID NO: 22016 - DNA, 23 bp, Homo sapiens
aggcaccctggacctggacaagg

SEQ ID NO: 22017 - DNA, 23 bp, Homo sapiens
gcctggctcaagtgaacagcacg

SEQ ID NO: 22018 - DNA, 24 bp, Homo sapiens
tcccatcttgtcctagcccatccc

SEQ ID NO: 22019 - DNA, 24 bp, Homo sapiens
gctctgccctgcataataaaatgg

SEQ ID NO: 22020 - DNA, 24 bp, Homo sapiens
cgctctgccctgcataataaaatg

SEQ ID NO: 22021 - DNA, 24 bp, Homo sapiens
ccgctctgccctgcataataaaat

SEQ ID NO: 22022 - DNA, 24 bp, Homo sapiens
cagactatcaggtattccaagttt

SEQ ID NO: 22023 - DNA, 24 bp, Homo sapiens
tcagactatcaggtattccaagtt

SEQ ID NO: 22024 - DNA, 24 bp, Homo sapiens
ctcagactatcaggtattccaagt

SEQ ID NO: 22025 - DNA, 24 bp, Homo sapiens
acgaaataaccctacattaatcag

SEQ ID NO: 22026 - DNA, 24 bp, Homo sapiens
aacgaaataaccctacattaatca

SEQ ID NO: 22027 - DNA, 24 bp, Homo sapiens
taacgaaataaccctacattaatc

SEQ ID NO: 22028 - DNA, 24 bp, Homo sapiens
gagaaatagcacatataatcaagt

SEQ ID NO: 22029 - DNA, 24 bp, Homo sapiens
agagaaatagcacatataatcaag

SEQ ID NO: 22030 - DNA, 24 bp, Homo sapiens
tagagaaatagcacatataatcaa

SEQ ID NO: 22031 - DNA, 24 bp, Homo sapiens
cagatgaacgggtccagtccaggt

SEQ ID NO: 22032 - DNA, 24 bp, Homo sapiens
acagatgaacgggtccagtccagg

SEQ ID NO: 22033 - DNA, 24 bp, Homo sapiens
aacagatgaacgggtccagtccag

SEQ ID NO: 22034 - DNA, 24 bp, Homo sapiens
atctgaatcggaagaagataaagg

SEQ ID NO: 22035 - DNA, 24 bp, Homo sapiens
tatctgaatcggaagaagataaag

SEQ ID NO: 22036 - DNA, 24 bp, Homo sapiens
ttatctgaatcggaagaagataaa

SEQ ID NO: 22037 - DNA, 25 bp, Homo sapiens
acttaccctgctgagctttctttgg

SEQ ID NO: 22038 - DNA, 25 bp, Homo sapiens
tgttttgttttgttttgttttgtgt

SEQ ID NO: 22039 - DNA, 23 bp, Homo sapiens
gactcgccccctcccccgttttt

SEQ ID NO: 22040 - DNA, 24 bp, Homo sapiens
ctttatttcaggtttaactgtagc

SEQ ID NO: 22041 - DNA, 24 bp, Homo sapiens
tctttatttcaggtttaactgtag

SEQ ID NO: 22042 - DNA, 24 bp, Homo sapiens
ttctttatttcaggtttaactgta

SEQ ID NO: 22043 - DNA, 24 bp, Homo sapiens
acttggatgatttgctgccgctga

SEQ ID NO: 22044 - DNA, 23 bp, Homo sapiens
gtggttggtgtggtctctgtggc

SEQ ID NO: 22045 - DNA, 23 bp, Homo sapiens
cgcctggaatctacaactcggag

SEQ ID NO: 22046 - DNA, 23 bp, Homo sapiens
ggtgtggtctctgtggctgtggc

SEQ ID NO: 22047 - DNA, 23 bp, Homo sapiens
tccttggatcgcaatacccttgg

SEQ ID NO: 22048 - DNA, 23 bp, Homo sapiens
tttggaaacgtcaagagatgtga

SEQ ID NO: 22049 - DNA, 25 bp, Homo sapiens
ggctcaagcgatcttcctacctcag

SEQ ID NO: 22050 - DNA, 25 bp, Homo sapiens
acaccactacggtagagacaaggtc

SEQ ID NO: 22051 - DNA, 24 bp, Homo sapiens
gggtagctgggaagctgggactat

SEQ ID NO: 22052 - DNA, 24 bp, Homo sapiens
gtgtagataaagtaagtaacagta

SEQ ID NO: 22053 - DNA, 24 bp, Homo sapiens
tgtgtagataaagtaagtaacagt

SEQ ID NO: 22054 - DNA, 24 bp, Homo sapiens
ttgtgtagataaagtaagtaacag

SEQ ID NO: 22055 - DNA, 24 bp, Homo sapiens
cgacctggaaggtaatgatatttt

SEQ ID NO: 22056 - DNA, 24 bp, Homo sapiens
acgacctggaaggtaatgatattt

SEQ ID NO: 22057 - DNA, 24 bp, Homo sapiens
gacgacctggaaggtaatgatatt

SEQ ID NO: 22058 - DNA, 24 bp, Homo sapiens
atgcaatggagatactttctaaag

SEQ ID NO: 22059 - DNA, 24 bp, Homo sapiens
tatgcaatggagatactttctaaa

SEQ ID NO: 22060 - DNA, 24 bp, Homo sapiens
ctatgcaatggagatactttctaa

SEQ ID NO: 22061 - DNA, 23 bp, Homo sapiens
tcttcccaccacaggcacaccag

SEQ ID NO: 22062 - DNA, 25 bp, Homo sapiens
ggacggtgaagaactatgagacagc

SEQ ID NO: 22063 - DNA, 23 bp, Homo sapiens
caccctgcgagattgcctggagc

SEQ ID NO: 22064 - DNA, 23 bp, Homo sapiens
ggactcgactcggcaccgctgtg

SEQ ID NO: 22065 - DNA, 23 bp, Homo sapiens
cggcgggctcagtcctcagcggg

SEQ ID NO: 22066 - DNA, 23 bp, Homo sapiens
gccgccgcctcccaccgctcccg

SEQ ID NO: 22067 - DNA, 23 bp, Homo sapiens
gcttgggccgtgggcttcgtgag

SEQ ID NO: 22068 - DNA, 23 bp, Homo sapiens
cactctggcctctgccctggggg

SEQ ID NO: 22069 - DNA, 23 bp, Homo sapiens
gttcgccatgcgtcccggggcgc

SEQ ID NO: 22070 - DNA, 24 bp, Homo sapiens
gccgcgcgatcacccggaacccgc

SEQ ID NO: 22071 - DNA, 24 bp, Homo sapiens
ggccgcgcgatcacccggaacccg

SEQ ID NO: 22072 - DNA, 24 bp, Homo sapiens
cggccgcgcgatcacccggaaccc

SEQ ID NO: 22073 - DNA, 24 bp, Homo sapiens
gatgtttttaggcaatatatgaaa

SEQ ID NO: 22074 - DNA, 24 bp, Homo sapiens
ggatgtttttaggcaatatatgaa

SEQ ID NO: 22075 - DNA, 24 bp, Homo sapiens
tggatgtttttaggcaatatatga

SEQ ID NO: 22076 - DNA, 24 bp, Homo sapiens
tatcacttcagatttgttgacaag

SEQ ID NO: 22077 - DNA, 24 bp, Homo sapiens
ttatcacttcagatttgttgacaa

SEQ ID NO: 22078 - DNA, 24 bp, Homo sapiens
tttatcacttcagatttgttgaca

SEQ ID NO: 22079 - DNA, 24 bp, Homo sapiens
tggaggatgctatattgataatac

SEQ ID NO: 22080 - DNA, 24 bp, Homo sapiens
ctggaggatgctatattgataata

SEQ ID NO: 22081 - DNA, 24 bp, Homo sapiens
tctggaggatgctatattgataat

SEQ ID NO: 22082 - DNA, 25 bp, Homo sapiens
gcacattcagcagtttcaggagagc

SEQ ID NO: 22083 - DNA, 23 bp, Homo sapiens
gccctctgctcttggtttccctc

SEQ ID NO: 22084 - DNA, 23 bp, Homo sapiens
ggtggctggagcaactgctggac

SEQ ID NO: 22085 - DNA, 24 bp, Homo sapiens
aaaggcacaaaaaattttagttta

SEQ ID NO: 22086 - DNA, 24 bp, Homo sapiens
caaaggcacaaaaaattttagttt

SEQ ID NO: 22087 - DNA, 24 bp, Homo sapiens
ccaaaggcacaaaaaattttagtt

SEQ ID NO: 22088 - DNA, 25 bp, Homo sapiens
atgaggctgagaagcagatcacagg

SEQ ID NO: 22089 - DNA, 23 bp, Homo sapiens
ctgtgctggtgctgctgctgtag

SEQ ID NO: 22090 - DNA, 24 bp, Homo sapiens
aagtatgtgccacgccaagtcctg

SEQ ID NO: 22091 - DNA, 23 bp, Homo sapiens
ctgtgctggtgctgctgctgtag

SEQ ID NO: 22092 - DNA, 24 bp, Homo sapiens
aagtatgtgccacgccaagtcctg

SEQ ID NO: 22093 - DNA, 23 bp, Homo sapiens
gcggacagagtacagcgaggaga

SEQ ID NO: 22094 - DNA, 23 bp, Homo sapiens
aggctgtggtgagggtctgagag

SEQ ID NO: 22095 - DNA, 24 bp, Homo sapiens
cctcctgccgtctgacttgagtcc

SEQ ID NO: 22096 - DNA, 23 bp, Homo sapiens
gcaacctcctccgcccacccatg

SEQ ID NO: 22097 - DNA, 23 bp, Homo sapiens
gcttcctggacacgctggtggtg

SEQ ID NO: 22098 - DNA, 23 bp, Homo sapiens
ccgtggacctggctgaggagctg

SEQ ID NO: 22099 - DNA, 23 bp, Homo sapiens
ggcaccagaggcagtaaccatgc

SEQ ID NO: 22100 - DNA, 24 bp, Homo sapiens
gcggcatcgagacatgcaagaaag

SEQ ID NO: 22101 - DNA, 24 bp, Homo sapiens
agcggcatcgagacatgcaagaaa

SEQ ID NO: 22102 - DNA, 24 bp, Homo sapiens
gagcggcatcgagacatgcaagaa

SEQ ID NO: 22103 - DNA, 24 bp, Homo sapiens
cgccgctcagaagaacattgaccg

SEQ ID NO: 22104 - DNA, 23 bp, Homo sapiens
ctgctggacggcgtggtggagaa

SEQ ID NO: 22105 - DNA, 23 bp, Homo sapiens
ctcaagaggaaggcggtggaatc

SEQ ID NO: 22106 - DNA, 24 bp, Homo sapiens
gccgacatcaacagcaagaaggtg

SEQ ID NO: 22107 - DNA, 23 bp, Homo sapiens
acacagcacagagaacaaggcgg

SEQ ID NO: 22108 - DNA, 25 bp, Homo sapiens
acctacaagtgtcagagcaactcgc

SEQ ID NO: 22109 - DNA, 23 bp, Homo sapiens
gtggcggcagtggtgacaggcga

SEQ ID NO: 22110 - DNA, 24 bp, Homo sapiens
aagaggcccaagtcttccagggag

SEQ ID NO: 22111 - DNA, 23 bp, Homo sapiens
ctctccgggcctgatgtcggcac

SEQ ID NO: 22112 - DNA, 25 bp, Homo sapiens
cgagcctaacattccatgatccagg

SEQ ID NO: 22113 - DNA, 23 bp, Homo sapiens
aggctgctgctgttgctgctgtg

SEQ ID NO: 22114 - DNA, 24 bp, Homo sapiens
ctgtctgcctggatgtgtgggaac

SEQ ID NO: 22115 - DNA, 25 bp, Homo sapiens
ggacgaggatgccatgtcacagatc

SEQ ID NO: 22116 - DNA, 23 bp, Homo sapiens
ctcaccagccgccacaagaacct

SEQ ID NO: 22117 - DNA, 23 bp, Homo sapiens
gtggtggacctcctgaacatcgt

SEQ ID NO: 22118 - DNA, 23 bp, Homo sapiens
acgccgccgctcttcctctcctc

SEQ ID NO: 22119 - DNA, 23 bp, Homo sapiens
agtctggactcctaccgaactcg

SEQ ID NO: 22120 - DNA, 23 bp, Homo sapiens
gcgtagacggcttgagggacttg

SEQ ID NO: 22121 - DNA, 24 bp, Homo sapiens
cgtgaacaagggtgggtgaatgcc

SEQ ID NO: 22122 - DNA, 24 bp, Homo sapiens
ccgtgaacaagggtgggtgaatgc

SEQ ID NO: 22123 - DNA, 24 bp, Homo sapiens
accgtgaacaagggtgggtgaatg

SEQ ID NO: 22124 - DNA, 24 bp, Homo sapiens
cttcaaagtggaatttgaggttaa

SEQ ID NO: 22125 - DNA, 24 bp, Homo sapiens
acttcaaagtggaatttgaggtta

SEQ ID NO: 22126 - DNA, 24 bp, Homo sapiens
aacttcaaagtggaatttgaggtt

SEQ ID NO: 22127 - DNA, 25 bp, Homo sapiens
ctcaagcaattctcccacctcagcc

SEQ ID NO: 22128 - DNA, 25 bp, Homo sapiens
tggaatgcagtagcgtagtcacagc

SEQ ID NO: 22129 - DNA, 24 bp, Homo sapiens
ggaggctgcagaccctgcacttgc

SEQ ID NO: 22130 - DNA, 24 bp, Homo sapiens
gggaggctgcagaccctgcacttg

SEQ ID NO: 22131 - DNA, 24 bp, Homo sapiens
agggaggctgcagaccctgcactt

SEQ ID NO: 22132 - DNA, 24 bp, Homo sapiens
gaaatttcttggtaagagttaaat

SEQ ID NO: 22133 - DNA, 24 bp, Homo sapiens
agaaatttcttggtaagagttaaa

SEQ ID NO: 22134 - DNA, 24 bp, Homo sapiens
cagaaatttcttggtaagagttaa

SEQ ID NO: 22135 - DNA, 24 bp, Homo sapiens
aggaagttgagaacgtgtttgtgc

SEQ ID NO: 22136 - DNA, 24 bp, Homo sapiens
aaggaagttgagaacgtgtttgtg

SEQ ID NO: 22137 - DNA, 24 bp, Homo sapiens
aaaggaagttgagaacgtgtttgt

SEQ ID NO: 22138 - DNA, 23 bp, Homo sapiens
gtctcgcactgtcacccaggctg

SEQ ID NO: 22139 - DNA, 23 bp, Homo sapiens
cccacattcccgaggacgaggag

SEQ ID NO: 22140 - DNA, 24 bp, Homo sapiens
cctcttggagcatctttggggctg

SEQ ID NO: 22141 - DNA, 24 bp, Homo sapiens
agcaaaaccagctatatctgaaaa

SEQ ID NO: 22142 - DNA, 24 bp, Homo sapiens
aagcaaaaccagctatatctgaaa

SEQ ID NO: 22143 - DNA, 24 bp, Homo sapiens
gaagcaaaaccagctatatctgaa

SEQ ID NO: 22144 - DNA, 24 bp, Homo sapiens
gagaaaaaaagaaatacacaaaga

SEQ ID NO: 22145 - DNA, 24 bp, Homo sapiens
tgagaaaaaaagaaatacacaaag

SEQ ID NO: 22146 - DNA, 24 bp, Homo sapiens
ttgagaaaaaaagaaatacacaaa

SEQ ID NO: 22147 - DNA, 24 bp, Homo sapiens
gagaaaaaaaggttagttgttttc

SEQ ID NO: 22148 - DNA, 24 bp, Homo sapiens
tgagaaaaaaaggttagttgtttt

SEQ ID NO: 22149 - DNA, 24 bp, Homo sapiens
ttgagaaaaaaaggttagttgttt

SEQ ID NO: 22150 - DNA, 24 bp, Homo sapiens
aaagcagaaaagtcccatcagttt

SEQ ID NO: 22151 - DNA, 24 bp, Homo sapiens
caaagcagaaaagtcccatcagtt

SEQ ID NO: 22152 - DNA, 24 bp, Homo sapiens
acaaagcagaaaagtcccatcagt

SEQ ID NO: 22153 - DNA, 24 bp, Homo sapiens
gctgctggagtggcggtagtaatg

SEQ ID NO: 22154 - DNA, 25 bp, Homo sapiens
acggattgactaagcgaaccatgac

SEQ ID NO: 22155 - DNA, 25 bp, Homo sapiens
ctgatgtcaaagaccgagcagtggg

SEQ ID NO: 22156 - DNA, 25 bp, Homo sapiens
aaacagccaagcccaaaccaacaaa

SEQ ID NO: 22157 - DNA, 25 bp, Homo sapiens
aggaacatcagaagtcacagaatca

SEQ ID NO: 22158 - DNA, 25 bp, Homo sapiens
aagcagacatgaagcatcttagaga

SEQ ID NO: 22159 - DNA, 23 bp, Homo sapiens
ctgccaacctgcctgctctcctg

SEQ ID NO: 22160 - DNA, 23 bp, Homo sapiens
atgtgtaactacttggtgccagc

SEQ ID NO: 22161 - DNA, 25 bp, Homo sapiens
caccctctactggcttggcaacttt

SEQ ID NO: 22162 - DNA, 23 bp, Homo sapiens
gaggctcactggctacgggatct

SEQ ID NO: 22163 - DNA, 23 bp, Homo sapiens
cacacgagctggtgctggtgctg

SEQ ID NO: 22164 - DNA, 23 bp, Homo sapiens
actcttccgagagctagacacgc

SEQ ID NO: 22165 - DNA, 25 bp, Homo sapiens
cctcttccttctcttcacactactg

SEQ ID NO: 22166 - DNA, 23 bp, Homo sapiens
caccgaagccaactcctgccaca

SEQ ID NO: 22167 - DNA, 24 bp, Homo sapiens
ggagaggaggacgaggatgtagcc

SEQ ID NO: 22168 - DNA, 24 bp, Homo sapiens
agttttacctggtaagttaatagt

SEQ ID NO: 22169 - DNA, 24 bp, Homo sapiens
gagttttacctggtaagttaatag

SEQ ID NO: 22170 - DNA, 24 bp, Homo sapiens
cgagttttacctggtaagttaata

SEQ ID NO: 22171 - DNA, 23 bp, Homo sapiens
gaaaatagccatcagaaatgttt

SEQ ID NO: 22172 - DNA, 23 bp, Homo sapiens
agctgtttacacaaggaatatta

SEQ ID NO: 22173 - DNA, 24 bp, Homo sapiens
aaagaaaagttgcttttcaacaag

SEQ ID NO: 22174 - DNA, 24 bp, Homo sapiens
gaagccatcagaatcaaaaatctt

SEQ ID NO: 22175 - DNA, 24 bp, Homo sapiens
agaagccatcagaatcaaaaatct

SEQ ID NO: 22176 - DNA, 24 bp, Homo sapiens
aagaagccatcagaatcaaaaatc

SEQ ID NO: 22177 - DNA, 23 bp, Homo sapiens
ccaacctgacagtgaggcagcac

SEQ ID NO: 22178 - DNA, 24 bp, Homo sapiens
atcgccatcacacggttagtggat

SEQ ID NO: 22179 - DNA, 24 bp, Homo sapiens
ccgtcagtggtgcttctggatgag

SEQ ID NO: 22180 - DNA, 23 bp, Homo sapiens
aaggagcaggagctgggtgattt

SEQ ID NO: 22181 - DNA, 23 bp, Homo sapiens
ggattttgatccctcagtgaagt

SEQ ID NO: 22182 - DNA, 23 bp, Homo sapiens
tcctcccccaggaagagccttaa

SEQ ID NO: 22183 - DNA, 24 bp, Homo sapiens
cgctgtgaaggattctgttctctg

SEQ ID NO: 22184 - DNA, 24 bp, Homo sapiens
gccagtgcagaagaatcaagacag

SEQ ID NO: 22185 - DNA, 24 bp, Homo sapiens
gtgtgggccaggctgtgaattctt

SEQ ID NO: 22186 - DNA, 23 bp, Homo sapiens
ggctcacctccccaccccacctg

SEQ ID NO: 22187 - DNA, 24 bp, Homo sapiens
ggagatctcaccgttctggagaca

SEQ ID NO: 22188 - DNA, 23 bp, Homo sapiens
gtgctccccgccccctgccgcgg

SEQ ID NO: 22189 - DNA, 24 bp, Homo sapiens
tttttgtgaagagagatggaaaac

SEQ ID NO: 22190 - DNA, 24 bp, Homo sapiens
atttttgtgaagagagatggaaaa

SEQ ID NO: 22191 - DNA, 24 bp, Homo sapiens
catttttgtgaagagagatggaaa

SEQ ID NO: 22192 - DNA, 24 bp, Homo sapiens
ggctcaagcaatcctcctgtctca

SEQ ID NO: 22193 - DNA, 25 bp, Homo sapiens
gatcaggagtccctgtagccttgac

SEQ ID NO: 22194 - DNA, 23 bp, Homo sapiens
ccatcaccaccagcagcagcagc

SEQ ID NO: 22195 - DNA, 23 bp, Homo sapiens
tgggcgagcacatacactacggc

SEQ ID NO: 22196 - DNA, 23 bp, Homo sapiens
caccatcaccctgcccaccgcat

SEQ ID NO: 22197 - DNA, 24 bp, Homo sapiens
agatatgcaagaggatgtattcct

SEQ ID NO: 22198 - DNA, 24 bp, Homo sapiens
cagatatgcaagaggatgtattcc

SEQ ID NO: 22199 - DNA, 24 bp, Homo sapiens
tcagatatgcaagaggatgtattc

SEQ ID NO: 22200 - DNA, 23 bp, Homo sapiens
cccagtatgagggagatcgtgca

SEQ ID NO: 22201 - DNA, 23 bp, Homo sapiens
gaccctcagcagccagcccggcc

SEQ ID NO: 22202 - DNA, 23 bp, Homo sapiens
cgcccgtccgcagccgcccgcca

SEQ ID NO: 22203 - DNA, 24 bp, Homo sapiens
cgtggtggcaggccttgggtctaa

SEQ ID NO: 22204 - DNA, 24 bp, Homo sapiens
tcgtggtggcaggccttgggtcta

SEQ ID NO: 22205 - DNA, 24 bp, Homo sapiens
ctcgtggtggcaggccttgggtct

SEQ ID NO: 22206 - DNA, 24 bp, Homo sapiens
cagcaacacatgtaagttttatag

SEQ ID NO: 22207 - DNA, 24 bp, Homo sapiens
tcagcaacacatgtaagttttata

SEQ ID NO: 22208 - DNA, 24 bp, Homo sapiens
ttcagcaacacatgtaagttttat

SEQ ID NO: 22209 - DNA, 25 bp, Homo sapiens
caattctcctgcctcagcgattaca

SEQ ID NO: 22210 - DNA, 23 bp, Homo sapiens
gagccacctgcccagccatgttt

SEQ ID NO: 22211 - DNA, 25 bp, Homo sapiens
agaactttgaagaggaaatggtgct

SEQ ID NO: 22212 - DNA, 24 bp, Homo sapiens
gaccaccaggacctccagcaagat

SEQ ID NO: 22213 - DNA, 24 bp, Homo sapiens
atcggaacacagagttggaggact

SEQ ID NO: 22214 - DNA, 24 bp, Homo sapiens
gaagactggcggctgcgtgagact

SEQ ID NO: 22215 - DNA, 24 bp, Homo sapiens
caacaatagcagttgcacacatga

SEQ ID NO: 22216 - DNA, 24 bp, Homo sapiens
tcaacaatagcagttgcacacatg

SEQ ID NO: 22217 - DNA, 24 bp, Homo sapiens
atcaacaatagcagttgcacacat

SEQ ID NO: 22218 - DNA, 24 bp, Homo sapiens
aacagcaagaattggcagcaacgc

SEQ ID NO: 22219 - DNA, 25 bp, Homo sapiens
aacaccttgctgtcagacttctggc

SEQ ID NO: 22220 - DNA, 24 bp, Homo sapiens
acggtactttgttacagcagccct

SEQ ID NO: 22221 - DNA, 24 bp, Homo sapiens
ccatagctcagttcaaatatttga

SEQ ID NO: 22222 - DNA, 24 bp, Homo sapiens
tccatagctcagttcaaatatttg

SEQ ID NO: 22223 - DNA, 24 bp, Homo sapiens
ctccatagctcagttcaaatattt

SEQ ID NO: 22224 - DNA, 24 bp, Homo sapiens
agaaaacatgagtaagatctaggc

SEQ ID NO: 22225 - DNA, 24 bp, Homo sapiens
aagaaaacatgagtaagatctagg

SEQ ID NO: 22226 - DNA, 24 bp, Homo sapiens
gaagaaaacatgagtaagatctag

SEQ ID NO: 22227 - DNA, 23 bp, Homo sapiens
aaggaggcgagagtgaccgtgtt

SEQ ID NO: 22228 - DNA, 23 bp, Homo sapiens
ggcgtcgtgctcgtgctctccag

SEQ ID NO: 22229 - DNA, 24 bp, Homo sapiens
catcctgctcctgaacttcctgcg

SEQ ID NO: 22230 - DNA, 23 bp, Homo sapiens
aaggaggcgagagtgaccgtgtt

SEQ ID NO: 22231 - DNA, 23 bp, Homo sapiens
cctgctcctgacggtgctggtgg

SEQ ID NO: 22232 - DNA, 25 bp, Homo sapiens
cctacatagtggctctcctatacga

SEQ ID NO: 22233 - DNA, 24 bp, Homo sapiens
gcgggcactgatcaaggagaaatt

SEQ ID NO: 22234 - DNA, 24 bp, Homo sapiens
cgcgggcactgatcaaggagaaat

SEQ ID NO: 22235 - DNA, 24 bp, Homo sapiens
tcgcgggcactgatcaaggagaaa

SEQ ID NO: 22236 - DNA, 24 bp, Homo sapiens
ttttatttcagcatttgcaagtga

SEQ ID NO: 22237 - DNA, 24 bp, Homo sapiens
gttttatttcagcatttgcaagtg

SEQ ID NO: 22238 - DNA, 24 bp, Homo sapiens
tgttttatttcagcatttgcaagt

SEQ ID NO: 22239 - DNA, 24 bp, Homo sapiens
tgcataataaggtaccatgtatta

SEQ ID NO: 22240 - DNA, 24 bp, Homo sapiens
atgcataataaggtaccatgtatt

SEQ ID NO: 22241 - DNA, 24 bp, Homo sapiens
tatgcataataaggtaccatgtat

SEQ ID NO: 22242 - DNA, 25 bp, Homo sapiens
ttcctttccaccattattatgaggc

SEQ ID NO: 22243 - DNA, 23 bp, Homo sapiens
caggagtttccctacacaagctc

SEQ ID NO: 22244 - DNA, 25 bp, Homo sapiens
tgctgccatccatgtaagacatgac

SEQ ID NO: 22245 - DNA, 23 bp, Homo sapiens
gagtgcgtctcggacagcgaatg

SEQ ID NO: 22246 - DNA, 23 bp, Homo sapiens
agctccaggctgaccagaactgc

SEQ ID NO: 22247 - DNA, 24 bp, Homo sapiens
tcaggcacaggagcagagaagact

SEQ ID NO: 22248 - DNA, 23 bp, Homo sapiens
caccatgcctgcttgtcgcctag

SEQ ID NO: 22249 - DNA, 23 bp, Homo sapiens
tagccgccgccctcctcctcagc

(The sequence listing continues in the following parts.)

The invention claimed is:

1. A product comprising a support on which is immobilized a plurality of probes, the probes consisting of at least 15 consecutive nucleotides of each of SEQ ID NO: 2363, 2364, 5307, 5426, 4218 and 5063, or the complements thereof.

2. A kit comprising the product according to claim 1 and reagents for a hybridization reaction.

3. The product of claim 1, wherein the support is solid or semi-solid.

4. The product of claim 3, wherein the support is selected from a slide, a bead, a membrane, a filter, a column, and a plate.

* * * * *